United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 26

SEQ ID NO: 29140 - DNA, 6447 bp, Homo sapiens
gtaatggaagtggtggaagcagagaaaatagtactgttgacttcagcaaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtgttgatccctcaattgttaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgtaggactggatgaatggggttgtgaaactgatttgacaagagaataatttacaaaaatcaaatgagtattgagaagccacagaaatatcaaaaatggtgacatcactattaggatgaaaattttatgaaattccaatgctccctttaaccatataattaaattacaaaggtatacataattaatctaataaaggatcatgaggaatgccaaaagctgaaattttagcaagtctggtgttttaaattcattataaactatttattaactaatgtaatgtcctcctctaagaccatattgtaagagtcttgttaaaatgatggattcaacttctgcctcggatgagaggttggaaatgtagctgcttttctttagaaaatatgtagctgtcatcatttggtactgcctaaaaagagttagactctattggcaattgatagagtattacccacggtgcttattattgtttatgagcttccattgtaatgattcctttttatttgtagcagcataattatttccaaagaccccagtatttgctgctatttttaaaactcccctgatgtacctgaacaagaggatttcctcacatcatttccttgtgtctggacatcaggggtaacaactgtacttactttacaggaagaaattttaaaactgaaaactacctgggatcatagtgtttctgtgattttatttaattgtgtatagtaattatccagtgccagaaaaaccgtcacttgcaaaatactttgcactcaaaatgtttttacaatgcttctaaatgttactggtttctgctttcttttgactacttgactgacaaaatgatctgactactccatttaagagcaaaggtaactcatgtttaggtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataaatgtgctcagcagtttaacatgtgaatcctgttttaaagtgctcagatttcaactgtgtaagccattgatataacgctgtaattaaaaatgtttatatgaaataacttaatgttttaaatttatttatgtagatcacatcatttttatcgtatgcagtgcaaatatgtgaaatgtcttttggtttattccaacaattatttattttagaaagtaagtttaaagactttaaggacattcaaagtttaaaatagtgttcaaattgcaaaatttggcaatcttcatataaattggtttcttttctaacttttcaaaaactaacattaaatgtcaattataggaaaacatagttggaaatgtaatcatccaaagatcatttttaaaatgaaatttaattagcacatattgaacatttgacttaattgttaaaccccagttttgttttgtttttttaatcagatttttgcacactgattagtttttgtgttgtggcttttgttgctttattattcaaggttttttttttttttcttccccatgggggagattgtcttccaatgtttaactacgtttaaataaataaaaattgaattttattgttcatttatataaaatctgataccttgatgtaatttcacaatacagttccaatttttatggcttttataattacaatgatattttcttctataataaaatccaaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagcaataaaagtctacttaatta

SEQ ID NO: 29141 - DNA, 3041 bp, Homo sapiens
cccgagcccaggcttcccaggccgctccctgagggcgaggggaggccagcccgggacaccagggggcgctccgggcggttggggaccaggccagggctgcgagagagtgaccttgggccgaacctgggatctggcccatctctgccgcatcccttgcgccgcccgcccaggagccctgacagccggcgggcggcgacctcttgttctcctcgcgtctttctgttggaaggggccggcgtctggcctcgcgttgtcctgccagaacgtgggcagaaagggtagcagggaccttgctctgagaccagatgaagaagctgtggtggatcagggtgggaccagtacaattctcaacattcactatgaaaaagaagagctggaaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacgacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgaatgccaggagatgcatggagagttcatgggatctgcgtgcggccatcatggaccctacactcctgatgtcctcttttggtcctgtattctctttttcaccaccttcatcctctcaagcaccttaaagacgtttaagacgagccgttatttcccaaccagaatggagtcttgctctgtcgcctggctggagtgcggtggtgtgatcttggctcactgcaacctccgcctcctcccgagtagctgggactacaggcacgcaccaccacagccagctaatttttgtatttttagtagagacggggtttccccatgttggccaggatggtctcaatctcttgacctcgtgatctgcctgcctcggcctcccaaaatgctgggattacaagcatgagcctggccaagtgctattctttatttcagattgagagttgggaaaaactggagcaaataatggatttctttcttgcttaaaatgtatttatatgtatgtcttattatatacaaggcagatttccctggaataaaagtctagaatgtgctgcttaattttacacatgtgtgcaggcaatattatctgtgagtgaaaagtggaataatacgtggattgggtcaactgattatcagcttgttaggagtcctctgtgtgagacatggtggtataattgtgaagttctcactgtatgtggatgttcatgtgaaagatagtactttcttcccgtaaatatcttttgatttccatttgtatggaatcccaatgaatgtatctttggaaaacataa

SEQ ID NO: 29142 - DNA, 3997 bp, Homo sapiens
attggttgcggcggatgcctcgcgggccggtggctatggaggcggcggcggttgatggttgaccgttggctccggggtgggggtcgccgttcgagtgatctgctcagacccgaccagagggcgcgggctgctgatgcttggcttggagcccgtgggggagacctagttcggctccgccatgccggccgccgggagtaacgagccggacggcgtcctcagctatcagagaccagatgaagaagctgtggtggatcagggtgggaccagtacaattctcaacattcactatgaaaaagaagagctggaaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacgacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgaatgccaggagatgcatggagagttcatgggatctgcgtgcggccatcatggaccctacactcctgatgtcctcttttggtcctgtattctctttttcaccaccttcatcctctcaagcaccttaaagacgtttaagacgagccgttatttcccaaccagagtacgctccatggtgagtgactttgctgttttcctcactatcttcacaatggtgattattgattttttgattggagtcccatcaccaaagcttcaagttcccagtgtgttcaagccaacaagggatgatcgcggatggattattaatcccattggccccaatccctggtggactgtgatagctgcaattatcccagctcttctctgtactatcttgatattcatggatcagcagatcacagccgtcattattaacaggaaggaacataagctcaagaaaggctgtggctaccacctggacctactgatggtggccatcatgctgggtgtctgctccatcatgggcctgccctggtttgtagctgcaactgtcttgtccatcacacatgtgaacagcctcaagctagaatctgaatgctctgctcctggagaacagcccaagttcctgggcatccgagaacagagagtgacaggccttatgatctttgtgctgatgggctgctcagtcttcatgacggctatcttaaagtttattccaatgccagtactctacggagttttcctttacatgggagtttcttcactacagggaattcagttctttgatcgtctaaagctctttgggatgcccgcaaagcaccagccagatttcatctacctgcggcatgtgccgctgcgcaaagtgcacctcttcaccctcatccagttgacctgtctcgtcctgctctgggtcatcaaggcatctccagctgccattgttttcccaatgatggttttggccttggtctttgtcaggaaagtcatggatctctgtttctctaagcgagagctgagctggctagatgatctcatgcctgaaagcaaaaagaagaagttggatgatgccaaaaagaaggccaaggaggaagaggtcatagtccttgcaccaactgtatacctgggggcctcaaattacagaacataggaagggtcatgtgaaaagtcagcatgtctggaatcccgagggttatatttaggagctgggaagattacccccaaagatgttctcagctaagaatggattagggattcttgcttctgtctgttcttaatttttgggtttgacaaccacttattttttcctttgtttacaatctactcaccaggctcatacctacaatgtgaacatacagtatgcccttattagcagattcaatggctcacattctttcaaaaggtctaatttgacaaatacataagacccattatttcctagaatgtttgtaatatatctaattgcaaatggtgctgtggttggcaccatgcaaagataacttgcataggactttctgtcttttttcatttccctcagcacttggcatcttgtcatctacacaatggaccctcaataaatggcctatatgtgcaaagaaagaatgtgtagcaaatgaaaataccagaccaagaaatgagtgagctgggaagtgtttccaaatacagttagtgcctaaaatagtgtcctttgaaaaaacttttaaaagacttttttttaggccaggcataatgggttatccctgtaattccagggcttttgggagttgaagctggaggattacttgaggccagaagtttgagactagcctaggcaatataatgagaccctgtctct

SEQ ID NO: 29143 - DNA, 4965 bp, Homo sapiens
gctgtcagaacgagtgggaacgtagctggtcgcagagggcaccagcggctgcaggacttcaccaagggaccctgaggctcgtgagcagggacccgcggtgcgggttatgctgggggctcagatcaccgtagacaactggacactcaggaccacgccatggaggagctgcaggatgattatgaagacatgatggaggagaatctggagcaggaggaatatgaagacccagacatccccgagtcccagatggaggagccggcagctcacgacaccgaggcaacagccacagactaccacaccacatcacacccgggtacccacaaggtctatgtggagctgcaggagctggtgatggacgaaaagaaccaggagctgagatggatggaggcggcgcgctgggtgcaactggaggagaacctgggggagaatggggcctggggccgcccgcacctctctcacctcaccttctggagcctcctagagctgcgtagagtcttcaccaagggtactgtcctcctagacctgcaagagacctccctggctggagtggccaaccaactgctagacaggtttatctttgaagaccagatccggcctcaggaccgagaggagctgctccgggccctgctgcttaaacacagccacgctggagagctggaggccctggggggtgtgaagcctgcagtcctgacacgctctggggatccttcacagcctctgctcccccaacactcctcactggagacacagctcttctgtgagcagggagatgggggcacagaagggcactcaccatctggaattctggaaaagattcccccggattcagaggccacgttggtgctagtgggccgcgccgacttcctggagcagccggtgctgggcttcgtgaggctgcaggaggcagcggagctggaggcggtggagctgccggtgcctatacgcttcctctttgtgttgctgggacctgaggccccccacatcgattacacccagcttggccgggctgctgccaccctcatgtcagagagggtgttccgcatagatgcctacatggctcagagccgaggggagctgctgcactccctagagggcttcctggactgcagcctagtgctgcctcccaccgatgccccctccgagcaggcactgctcagtctggtgcctgtgcagagggagctacttcgaaggcgctatcagtccagccctgccaagccagactccagcttctacaagggcctagacttaaatgggggcccagatgaccctctgcagcagacaggccagctcttcgggggcctggtgcgtgatatccggcgccgctacccctattacctgagtgacatcacagatgcattcagcccccaggtcctggctgccgtcatcttcatctactttgctgcactgtcacccgccatcaccttcggcggcctcctgggagaaaagacccggaaccagatgggagtgtcggagctgctgatctccactgcagtgcagggcattctcttcgccctgctgggggctcagcccctgcttgtggtcggcttctcaggacccctgctggtgtttgaggaagccttcttctcgttctgcgagaccaacggtctagagtacatcgtgggccgcgtgtggatcggcttctggctcatcctgctggtggtgttggtggtggccttcgagggtagcttcctggtccgcttcatctcccgctatacccaggagatcttctccttcctcatttccctcatcttcatctatgagactttctccaagctgatcaagatcttccaggaccacccactacagaagacttataactacaacgtgttgatggtgcccaaacctcagggccccctgcccaacacagccctcctctcccttgtgctcatggccggtaccttcttctttgccatgatgctgcgcaagttcaagaacagctcctatttccctggcaagctgcgtcgggtcatcggggacttcggggtccccatctccatcctgatcatggtcctggtggatttcttcattcaggatacctacacccagaaactctcggtgcctgatggcttcaaggtgtccaactcctcagcccggggctgggtcatccacccactgggcttgcgttccgagtttcccatctggatgatgtttgcctccgccctgcctgctctgctggtcttcatcctcatattcctggagtctcagatcaccacgctgattgtcagcaaacctgagcgcaagatggtcaagggctccggcttccacctggacctgctgctggtagtaggcatgggtggggtggccgccctctttgggatgccctggctcagtgccaccaccgtgcgttccgtcacccatgccaacgccctcactgtcatgggcaaagccagcaccccaggggctgcagcccagatccaggaggtcaaagagcagcggatcagtggactcctggtcgctgtgcttgtgggcctgtccatcctcatggagcccatcctgtcccgcatccccctggctgtactgtttggcatcttcctctacatgggggtcacgtcgctcagcggcatccagctctttgaccgcatcttgcttctgttcaagccacccaagtatcacccagatgtgccctacgtcaagcgggtgaagacctggcgcatgcacttattcacgggcatccagatcatctgcctggcagtgctgtgggtggtgaagtccacgccggcctccctggccctgcccttcgtcctcatcctcactgtgccgctgcggcgcgtcctgctgccgctcatcttcaggaacgtggagcttcagtgtctggatgctgatgatgccaaggcaacctttgatgaggaggaaggtcgggatgaatacgacgaagtggccatgcctgtgtgaggggcgggcccaggccctagaccctcccccaccattccacatccccaccttccaaggaaaagcagaagttcatgggcacctcatggactccaggatcctcctggagcagcagctgaggccccagggctgtgggtggggaaggaaggcgtgtccaggagaccttccacaaagggtagcctggcttttctggctggggatggccgatggggcccacattagggggtttgttgcacagtccctcctgttgccacactttcactggggatcccgtgctggaagacttagatctgagccctccctcttcccagcacaggcaggggtagaagcaaaggcaggaggtgggtgagcgggtggggtgcttgctgtgtgaccttgggcaagtcccttgacctttccagcctatatttcctcttctgtaaaatgggtatattgatgataatacccacattacaggatggttactgaggaccaaagatacatgtaaaatagggctttgtaaactccacagggactgttctatagcagtcatcatttgtctttgaacgtacccaaggtcacatagctgggatttgaactgagccgtgcagctgggatttgaaccaggccttctgatttcaaggtccgagctctgtcctctgtcagtcatgcgtccactttcccttcccctgtgactcctcccttccccactctgctcccagcccctaccttgagaccctcttctctgggcccagagagaggcgtcctggtgaggacaaggtacaggcaaggatgatccagggattgggcctgggactcaggcctcctaagtgtttggttcctccctccaaacactcattagttcactcattcattcattccacaaacatttactgagggccccggaatcagtggactccgaggggactgagacaagccctgccctggggtgggggtggggggcaaggtacagttgattctacatttggatagggagtgggggagggtgggaaggtaggggcgggagagtgagggggtttgtaatttattaattgcgtattttctaagagttttcaacatagtttggcttcacacacaacttcaggcccctcatttgagagccattatcctcaactccatctaaactgaatcttggggagaacccagatctgaccaattggggtaggagacagcaggctctccaagaacatgggcaaatttatttttttataaaacaaaaagataaaaagagttgaaagacgtgaaagtggtgagagatggaggaaacagaatcaggaagtggtagaaaagagaggaggtggctgggcgcagtggctcacgtttgtaatcccagcactttgggaggccaagttgggcggatcatttgaggtcaggagtttgagaccagcctggccaacatggtgaaaccccgttactactaaaaatacaaaaattagctgggtgtctcgtggcaggcacctgtaatcccagctacttagaaggctgaggcaagagaatcacctgaacccaggaggtggaggttgcagtgagccaagattgcaccactgcactccagcctgggcaacagagcgagaccctgtctcaaaaaaaaaaaaaaaaaaaaaaaaaaaacggaaggaaacatcagccttgggggccacagactcaacatgtgtgtgtggtggggttccagcccaacatagagtaacattatttgtacctcccaggctagctcagtccatgggaggctctcctgtccctgaaagctgacacccacctttcaccacttcgcccatgctacagttcagtttcctcgtctgtaaaatggggatgataatggtacctaccttgcagtgttgttataaggattaaaggagacagtgcaagaaaaggccttggttggtgaagagcccaacctcggaggggagctgctgggatcctccttatcttgactgggatgtccctgtctccccctccccttgctccttgaacatggccaaggaaagtgaaaaacaaaaattattcactctgctagcacccttccccttgatgcctgggaataggttttgccaataaacgtatctgtgttggagtggc

SEQ ID NO: 29144 - DNA, 3969 bp, Homo sapiens
gccttcctctctctcagtgagtgagtggagttgagctcctgccctccacccagccagcctgcttccctcctgccggtccccaaggacctgggggagggaagcctcctgccggcctgtactggggagggggcaccccctccctgcaggggcatcttgggctctctccagagttcttccattcgtctgcttcctgtctcggcagcccggccccggctccacggggtgtctcaccctccccaccacaccctctctggtctcaggcccacctctggttatgcctccgcctcgttgccctgaaagccgcagcgacagcgaaaagggctaagattcggccatgagcagcgcccctcggcgccccgccaagggcgcagattctttctgtacgccagggccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagactgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacgcaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccc

SEQ ID NO: 29145 - DNA, 4142 bp, Homo sapiens
acggtgcgccggggggcgcgcacgcagggggctggcctgcccgcggcgcgggggaaagttgagttgggagaagttgggagcggcgggggcgcgccccggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagactgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacgcaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccaccta

SEQ ID NO: 29146 - DNA, 793 bp, Homo sapiens
cttctgtgccttcctctctctcagtgagtgagtggagttgagctcctgccctccacccagccagcctgcttccctcctgccggtccccaaggacctgggggagggaagcctcctgccggcctgtactggggagggggcaccccctccctgcaggggcatcttgggctctctccagagttcttccattcgtctgcttcctgtctcggcagcccggccccggctccacggggtgtctcaccctccccaccacaccctctctggtctcaggcccacctctggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctc

SEQ ID NO: 29147 - DNA, 500 bp, Homo sapiens
ataaagctctgcccagcccatgcccaccttctgtgccttcctctctctcagtgagttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatga

SEQ ID NO: 29148 - DNA, 571 bp, Homo sapiens
aagccaggaaatgcctcctgagagaggtgaaggcagcgtctcagtatgcaagggaagggattcagggtgaaggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctg

SEQ ID NO: 29149 - DNA, 4925 bp, Homo sapiens
cccagccctcttgaaaagggccgctccgggactacgcgttccagaatgcagcggaaatgggggcggagcgctctcggttaggggtttggggtttggcggcctagatcccgggcactggcggcccagcgctgacctggttggtggcattgtgttcccaacggcctcttgacgacctcagcacgggtttccacctctccccaagccacctagtgaccccagaattgactggggaatgcctgtgagcgatgatgacctcacagggaacagctgaccgcagggctgggagaacagctgtgccccttcgaggctggattttagtggagggacacacgccaaagaccccctctctgctgagccccgtttgttgtctcggagcccacccgactctagccgctgaactctgacatgctgaggaaaactgggtggagccctgggggtccccctcagaccccagtctccggaacagggcccactggagtcagccagggtgtggcaggcaggttggttaaccccctccacagacaagaccacagaccgatgctcaacttgcagcagcctctgcctcaccccttaaaggagctgattatagattcccttacgctgcctctctaattgtctcatgattgcattcttgagggctatggaccgagggaaaaggatcccaaacagcactcctcagcaccggaaccagagttgctgctaaacacgtgttaattaactcgtttctatctgaatgcttttgcatacacaagggaaaagaagcaaaaagtgtattccttatctggaagactttgtgatttcgttgggcaaaaaagaactacacacaaaggtcttgaatgataagtgatggctctgcctagggttcggttcagtgtggaggttccattcaagaggaaggaggccagcacagcgaatctctgtccctctctggaagtggagagcctctaacaagttaccctctcccagatcagctcagggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagactgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacgcaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccacct

SEQ ID NO: 29150 - DNA, 610 bp, Homo sapiens
attatcactccctccctcatctttgttgctttctctccgggcctgggccttgactcctttctccctcatttttcttgcggcctttcccacctcctctctcctcctccctctactcagcctctcggcccttttcggcccccctcgcctcagtcctctcctgtctccttgttcttctcttttcttcctataaataactctcctctgtgctgtggctgccgctaagggccactctgaggcccttcatactccaggaggatccccagcagcgcagcctgcgcgtggtggctcctgccctcccagggctctcgatggtgatcaggcctctcccccatccaggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagact

SEQ ID NO: 29151 - DNA, 702 bp, Homo sapiens
agaccacccctcccctccggcccccccgcatagtccttcagtcccgtccggggcgcccagactgggggttgcccggggcccccatccccaatctccgggttgagaggcgaagccaggaaaggcgggtggcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggacc

SEQ ID NO: 29152 - DNA, 5323 bp, Homo sapiens
gcggcggcggccgcggtggcagcgaaggcggcggcggcggcggcagtggcagtggccgctgcagccccacactccgccgccaaactggaggagcgacggaagccagaccccaggaggatggaggatgaagctgtcctggacagaggggcttccttcctcaagcatgtgtgtgatgaagaagaagtagaaggccaccataccatttacatcggagtccatgtgccgaagagttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcatctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagaaaggagcagggtatcacttggatctcttttgggtggccatcctcatggttatatgctccctcatggctcttccgtggtatgtagctgctacggtcatctccattgctcacatcgacagtttgaagatggagacagagacttctgcacctggagaacaaccaaagtttctaggagtgagggaacaaagagtcactggaacccttgtgtttattctgactggtctgtcagtctttatggctcccatcttgaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcacgacctcagcttcctggatgatgtcattccagaaaaggacaagaaaaagaaggaggatgagaagaaaaagaaaaagaagaagggaagtctggacagtgacaatgatgattctgactgcccatactcagaaaaagttccaagtattaaaattccaatggacatcatggaacagcaacctttcctaagcgatagcaaaccttctgacagagaaagatcaccaacattccttgaacgccacacatcatgctgataaaattcctttccttcagtcactcggtatgccaagtcctcctagaactccagtaaaagttgtgcctcaaattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagacacaatcaagacaatagtgcaccgttccttaaaaacagcatctgaggaatcccccttttgttcttaaactttcagatgtgtcctttgataaccaaattctgtcactcaagacacagacacgcacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaaccattgccatcattgtagcaagtgctggaatgtcccttttttcctatgcaactttttttaaccctttaatgaacttatctgttgagtacattgaagaatatttttcttcctagattttgttgtttaaattatggggcctaacctgccacttattttttgtcaatttttaaaacttttttttaattactgtaaagaaaatgaattttttcctgcagcaggaaacatagttttgagtagttctacctcttatttgtagctgccaggctttctgtaaaaattgtattgtatataatgtgatttttacacatacatacacacacaaatacacaatctctagggtaagccagaaggcaagatcagattaaaaacaccatgtttctaagcatccatttttccctttctttaaaagaaacttaactgttctatgaaggagattgagggagaagagacaaactcctatgtcatgagaataaccgatgttctgataatagtagcatctaggtacagatgctggttgtattaccacgtcaatgtcctatgcagtattgttagacattttctcattttgaaatatttgtgtgtttgtgtatgtgctctgtgccatggctggtgtatatatgtgcaatgttagaaggcaaaagagtgatggtaggcagagggcaaagtcattgaatctcttatgccagttttcataaaacccaaaccacatatgaaaaaatccattaagggtccaagaagtctgtccatatgaaaatgagggtaaatatagtttatttcccaggtatcagtcattataattgatataatagctctaacatgcaatataaaattcataggagtattaatagcccatttacacatctataaaatgtaatgggattgcagagctgcagagtacagtgtaacagtactctcatgcaatttttttcaggatgcaaaggcaattattctttgtaagcgggacatttagaatatatttgtgtacatattatatgtatgtatatttcaaagtaccacactgaaaattagacatttattaaccaaatttaacgtggtatttaaaggtaatatttttaatatgatacattacatattgtgaatgtatactaaaaaaacattttaaatgttaaaattataatttcagattcatataaccacaactgtgatatatcctaactataaccagttgttgaggggtatactagaagcagaatgaaaccacattttttggtttgataatatgcacttattgactcccac

SEQ ID NO: 29153 - DNA, 7640 bp, Homo sapiens
aggaggggaagtgagtggttagacctcagctcatctgagggctaaaggttctttgtgacacatcacacagaattggagtgctgtccttctggagagtggtggagaaccaagatacagttcagaaccaaaggaatagagaagggctttgatttctttttggctttagattggggatttgggaggcttagcaggaaagatgtccactgaaaatgtggaagggaagcccagtaaccttggggagagaggaagagcccggagctccactttcctcagggttgtccagccaatgtttaaccacagtattttcacttctgcagtctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagaaaggagcagggtatcacttggatctcttttgggtggccatcctcatggttatatgctccctcatggctcttccgtggtatgtagctgctacggtcatctccattgctcacatcgacagtttgaagatggagacagagacttctgcacctggagaacaaccaaagtttctaggagtgagggaacaaagagtcactggaacccttgtgtttattctgactggtctgtcagtctttatggctcccatcttgaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcacgacctcagcttcctggatgatgtcattccagaaaaggacaagaaaaagaaggaggatgagaagaaaaagaaaaagaagaagggaagtctggacagtgacaatgatgattctgactgcccatactcagaaaaagttccaagtattaaaattccaatggacatcatggaacagcaacctttcctaagcgatagcaaaccttctgacagagaaagatcaccaacattccttgaacgccacacatcatgctgataaaattcctttccttcagtcactcggtatgccaagtcctcctagaactccagtaaaagttgtgcctcaaattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagacacaatcaagacaatagtgcaccgttccttaaaaacagcatctgaggaatcccccttttgttcttaaactttcagatgtgtcctttgataaccaaattctgtcactcaagacacagacacgcacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaaccattgccatcattgtagcaagtgctggaatgtcccttttttcctatgcaactttttttaaccctttaatgaacttatctgttgagtacattgaagaatatttttcttcctagattttgttgtttaaattatggggcctaacctgccacttattttttgtcaatttttaaaacttttttttaattactgtaaagaaaatgaattttttcctgcagcaggaaacatagttttgagtagttctacctcttatttgtagctgccaggctttctgtaaaaattgtattgtatataatgtgatttttacacatacatacacacacaaatacacaatctctagggtaagccagaaggcaagatcagattaaaaacaccatgtttctaagcatccatttttccctttctttaaaagaaacttaactgttctatgaaggagattgagggagaagagacaaactcctatgtcatgagaataaccgatgttctgataatagtagcatctaggtacagatgctggttgtattaccacgtcaatgtcctatgcagtattgttagacattttctcattttgaaatatttgtgtgtttgtgtatgtgctctgtgccatggctggtgtatatatgtgcaatgttagaaggcaaaagagtgatggtaggcagagggcaaagtcattgaatctcttatgccagttttcataaaacccaaaccacatatgaaaaaatccattaagggtccaagaagtctgtccatatgaaaatgagggtaaatatagtttatttcccaggtatcagtcattataattgatataatagctctaacatgcaatataaaattcataggagtattaatagcccatttacacatctataaaatgtaatgggattgcagagctgcagagtacagtgtaacagtactctcatgcaatttttttcaggatgcaaaggcaattattctttgtaagcgggacatttagaatatatttgtgtacatattatatgtatgtatatttcaaagtaccacactgaaaattagacatttattaaccaaatttaacgtggtatttaaaggtaatatttttaatatgatacattacatattgtgaatgtatactaaaaaaacattttaaatgttaaaattataatttcagattcatataaccacaactgtgatatatcctaactataaccagttgttgaggggtatactagaagcagaatgaaaccacattttttggtttgataatatgcacttattgactcccactcattgttatgttaattaagttattattctgtctccttgtaattttgattacaaaaattttattatcctgagttagctgttacttttacagtacctgatactcctaaaacttttaacttatacaaattagtcaataatgaccccaattttttcattaaaataatagtggtgaattatatgttattgtgttaaaacctcacttgccaaattctggcttcacatttgtatttagggctatccttaaaatgatgagtctatattatctagctttctattaccctaatataaactggtataagaagactttccttttttctttatgcatggaagcatcaataaattgtttaaaaaccatgtatagtaaattcagcttaacccgtgatcttcttaagttaaaggtacttttgttttataaaagctctagataaaactttcttttctgatcatgaatcaagtatctgtggtttcatgcccctctctatacctttcaaagaactcctgaagcaacttaactcatcatttcagcctctgagtagaggtaaaacctatgtgtacttctgtttatgatccatattgatatttatgacatgaacacagaatagtaccttacatttgctaaacagacagttaatatcaaatcctttcaatattctgggaacccagggaagtttttaaaaatgtcattactttcaaaggaacagaagtagttaaccaaactaacaagcaaaacctgaggtttacctagtgacaccaaattatcggtattttaactgaatttacccattgactaagaatgaaccagatttggtggtggttttgtttctatgcaaactggacacaaattacaacagtaaatttttttataagtgcttctcccttctccatgatgtgacttccggagataaaggattcaaaagataaagacaaagtacgctcagagttgttaaccagaaagtcctggctgtggttgcagaaacactgttggaagaaaagagatgactaagtcaagtgtctgccttatcaaaagagcaaaaatgcctctggttttgtgtttgggagaaaagtatcttggacgcactgttttccttgataaaagtcatcttctctactgtgtgaaatgaatacttggaattctaattgttttgtgtgccaggggcagtaatgtccctgcctcttctcccaatcaaggttgaggagtggggctggggagaggacttaactgacttaagaagtaggaaaacaaaaacctctctcctcagccttccacctccaagagaggaggaaaaacagttgtctgctgtctgtaattcagtttgcgtgtattttatgctcatgcaccaacccatacagagtaaatcttttatcaactgtatactggtgtttaatagagaatgattgtcttccgagttttttggttccttttttaactgtgttaaagtacttgaaatgtattgactgctgactatattttaaaaacaaaatgaaataatttgagttgtattacagaggttgacattgttcagggatgggacaaagccttcttcaatccttttcatactacttaatgattttggtgcaggaacctgagattttctgatttatatttcatgatatttcacatttgctcttcacagcatgagcatgaagcccagtggcaccaaatggctgggtacaatcaagtgatattttgtagcacctcactatctgaaaggccatgagttttcagatgatttcattgagcttcattgcagcctgaaattttaaaaaagttgtgtaatacgccaaccagtcaagttgtgttttggccagagatttagatatgtccaatttcctggctcatttcattgtgctctatgggtacgtataaaaagcaagaattctgtttcctaggcaaacattgcaactcagggctaaagtcatccagtgaaacttttagagccagaagtaactttgtcccagtcctacaatgtgaaaagagtgaatagttgcctctttttagccattttcatggctggtacatattcgtacgcattacttttcagaatcaatacgcactttcagatattcttatttttattctcttaagtctttattaactttggagagagaaatgatgcatctttttattttaaatgaagtagatcaacatggtggaacaaaatgataaagaacagaaaacatttcaatatattactaataactttttccaatataaatcctaaaattcctataacatagtattttacagttttatgaagctttctattgtgacttttatggaattaagagatgaagaagatgagatattttagcatttatatttttcaaaattatatgtatacttaaaaataaagtaactttatgcattta

SEQ ID NO: 29154 - DNA, 3771 bp, Homo sapiens
ggcagtggcagtggccgctgcagccccacactccgccgccaaactggaggagcgacggaagccagaccccaggaggatggaggatgaagctgtcctggacagaggggcttccttcctcaagcatgtgtgtgatgaagaagaagtagaaggccaccataccatttacatcggagtccatgtgccgaagagttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcatctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcacgacctcagcttcctggatgatgtcattccagaaaaggacaagaaaaagaaggaggatgagaagaaaaagaaaaagaagaagggaagtctggacagtgacaatgatgattctgactgcccatactcagaaaaagttccaagtattaaaattccaatggacatcatggaacagcaacctttcctaagcgatagcaaaccttctgacagagaaagatcaccaacattccttgaacgccacacatcatgctgataaaattcctttccttcagtcactcggtatgccaagtcctcctagaactccagtaaaagttgtgcctcaaattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagacacaatcaagacaatagtgcaccgttccttaaaaacagcatctgaggaatcccccttttgttcttaaactttcagatgtgtcctttgataaccaaattctgtcactcaagacacagacacgcacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaac

SEQ ID NO: 29155 - DNA, 7596 bp, Homo sapiens
gcggcggcggccgcggtggcagcgaaggcggcggcggcggcggcagtggcagtggccgctgcagccccacactccgccgccaaactggaggagcgacggaagccagaccccaggaggatggaggatgaagctgtcctggacagaggggcttccttcctcaagcatgtgtgtgatgaagaagaagtagaaggccaccataccatttacatcggagtccatgtgccgaagagttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcatctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagaaaggagcagggtatcacttggatctcttttgggtggccatcctcatggttatatgctccctcatggctcttccgtggtatgtagctgctacggtcatctccattgctcacatcgacagtttgaagatggagacagagacttctgcacctggagaacaaccaaagtttctaggagtgagggaacaaagagtcactggaacccttgtgtttattctgactggtctgtcagtctttatggctcccatcttgaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcacgacctcagcttcctggatgatgtcattccagaaaaggacaagaaaaagaaggaggatgagaagaaaaagaaaaagaagaagggaagtctggacagtgacaatgatgatgagaaagatcaccaacattccttgaacgccacacatcatgctgataaaattcctttccttcagtcactcggtatgccaagtcctcctagaactccagtaaaagttgtgcctcaaattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagacacaatcaagacaatagtgcaccgttccttaaaaacagcatctgaggaatcccccttttgttcttaaactttcagatgtgtcctttgataaccaaattctgtcactcaagacacagacacgcacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaaccattgccatcattgtagcaagtgctggaatgtcccttttttcctatgcaactttttttaaccctttaatgaacttatctgttgagtacattgaagaatatttttcttcctagattttgttgtttaaattatggggcctaacctgccacttattttttgtcaatttttaaaacttttttttaattactgtaaagaaaatgaattttttcctgcagcaggaaacatagttttgagtagttctacctcttatttgtagctgccaggctttctgtaaaaattgtattgtatataatgtgatttttacacatacatacacacacaaatacacaatctctagggtaagccagaaggcaagatcagattaaaaacaccatgtttctaagcatccatttttccctttctttaaaagaaacttaactgttctatgaaggagattgagggagaagagacaaactcctatgtcatgagaataaccgatgttctgataatagtagcatctaggtacagatgctggttgtattaccacgtcaatgtcctatgcagtattgttagacattttctcattttgaaatatttgtgtgtttgtgtatgtgctctgtgccatggctggtgtatatatgtgcaatgttagaaggcaaaagagtgatggtaggcagagggcaaagtcattgaatctcttatgccagttttcataaaacccaaaccacatatgaaaaaatccattaagggtccaagaagtctgtccatatgaaaatgagggtaaatatagtttatttcccaggtatcagtcattataattgatataatagctctaacatgcaatataaaattcataggagtattaatagcccatttacacatctataaaatgtaatgggattgcagagctgcagagtacagtgtaacagtactctcatgcaatttttttcaggatgcaaaggcaattattctttgtaagcgggacatttagaatatatttgtgtacatattatatgtatgtatatttcaaagtaccacactgaaaattagacatttattaaccaaatttaacgtggtatttaaaggtaatatttttaatatgatacattacatattgtgaatgtatactaaaaaaacattttaaatgttaaaattataatttcagattcatataaccacaactgtgatatatcctaactataaccagttgttgaggggtatactagaagcagaatgaaaccacattttttggtttgataatatgcacttattgactcccactcattgttatgttaattaagttattattctgtctccttgtaattttgattacaaaaattttattatcctgagttagctgttacttttacagtacctgatactcctaaaacttttaacttatacaaattagtcaataatgaccccaattttttcattaaaataatagtggtgaattatatgttattgtgttaaaacctcacttgccaaattctggcttcacatttgtatttagggctatccttaaaatgatgagtctatattatctagctttctattaccctaatataaactggtataagaagactttccttttttctttatgcatggaagcatcaataaattgtttaaaaaccatgtatagtaaattcagcttaacccgtgatcttcttaagttaaaggtacttttgttttataaaagctctagataaaactttcttttctgatcatgaatcaagtatctgtggtttcatgcccctctctatacctttcaaagaactcctgaagcaacttaactcatcatttcagcctctgagtagaggtaaaacctatgtgtacttctgtttatgatccatattgatatttatgacatgaacacagaatagtaccttacatttgctaaacagacagttaatatcaaatcctttcaatattctgggaacccagggaagtttttaaaaatgtcattactttcaaaggaacagaagtagttaaccaaactaacaagcaaaacctgaggtttacctagtgacaccaaattatcggtattttaactgaatttacccattgactaagaatgaaccagatttggtggtggttttgtttctatgcaaactggacacaaattacaacagtaaatttttttataagtgcttctcccttctccatgatgtgacttccggagataaaggattcaaaagataaagacaaagtacgctcagagttgttaaccagaaagtcctggctgtggttgcagaaacactgttggaagaaaagagatgactaagtcaagtgtctgccttatcaaaagagcaaaaatgcctctggttttgtgtttgggagaaaagtatcttggacgcactgttttccttgataaaagtcatcttctctactgtgtgaaatgaatacttggaattctaattgttttgtgtgccaggggcagtaatgtccctgcctcttctcccaatcaaggttgaggagtggggctggggagaggacttaactgacttaagaagtaggaaaacaaaaacctctctcctcagccttccacctccaagagaggaggaaaaacagttgtctgctgtctgtaattcagtttgcgtgtattttatgctcatgcaccaacccatacagagtaaatcttttatcaactgtatactggtgtttaatagagaatgattgtcttccgagttttttggttccttttttaactgtgttaaagtacttgaaatgtattgactgctgactatattttaaaaacaaaatgaaataatttgagttgtattacagaggttgacattgttcagggatgggacaaagccttcttcaatccttttcatactacttaatgattttggtgcaggaacctgagattttctgatttatatttcatgatatttcacatttgctcttcacagcatgagcatgaagcccagtggcaccaaatggctgggtacaatcaagtgatattttgtagcacctcactatctgaaaggccatgagttttcagatgatttcattgagcttcattgcagcctgaaattttaaaaaagttgtgtaatacgccaaccagtcaagttgtgttttggccagagatttagatatgtccaatttcctggctcatttcattgtgctctatgggtacgtataaaaagcaagaattctgtttcctaggcaaacattgcaactcagggctaaagtcatccagtgaaacttttagagccagaagtaactttgtcccagtcctacaatgtgaaaagagtgaatagttgcctctttttagccattttcatggctggtacatattcgtacgcattacttttcagaatcaatacgcactttcagatattcttatttttattctcttaagtctttattaactttggagagagaaatgatgcatctttttattttaaatgaagtagatcaacatggtggaacaaaatgataaagaacagaaaacatttcaatatattactaataactttttccaatataaatcctaaaattcctataacatagtattttacagttttatgaagctttctattgtgacttttatggaattaagagatgaagaagatgagatattttagcatttatatttttcaaaattatatgtatacttaaaaataaagtaactttatgcattta

SEQ ID NO: 29156 - DNA, 6104 bp, Homo sapiens
accctaaaggaattggagtcagggcccaggagccacaggccactgcactggggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaagcatcaccttgcacttcaaaatatcctgtccagcttcacctgctttcagctactcacggaacccagtgttcatggtgccacaggtgaagatagagatggagtcagactatgacttcacagacatggataaataccgaagagaaactgacagtgagaccaccctctaggatgaagcagcttctcccagatgggagatggagagcctggcttagtcttcactgggagggtcttaacttctctgtgcctgtttccttctttatcaaacagagggagtccgtctgcctatagaaaactggagatctattgatgaaaagtattgcttagatgcaaagctctcccctttgtagtaattaaaatacctaaagctaaatattatattttattttaaaatgcagttcagcatagaaattctaacatttctttggaaataaaaaaatgcttgtttccccaaaccatagctaagataaaggggcaatagtcaattcatatttaaaacaaatatcaatttaaaattgtttaaaggttagatttaaatatagatgttctcaaacaaacttgtaatatacttttatgtcactagaccatctttggaatatttggcaattctgcatattaagaaatgctgaaaaggtcctatcttttctccctgtcacatccaatttcctaagggttatatgaaaagtttgaaccagccgggcacagtggcacacgcctgtaatcctagcactttgggaggccgaggcaggtgaattgcctgagctcaggagttcgagaccagcctaggcaacacggtgaaaccccgtctctactaaactacaaaaaattagccgggtgtggtggcatgcacctgtagtcccagctattcgggaggctgaggcaggagaatcgcttgaacccaggaggcagaagttgcagtgagctgagatggcaccactgcactccagcctaggcaacagagtgagactccgtatccaaacaaaaaaaaagtttgaaccatctgcattatgggccttgctccagaagtgtgactggggctttcccagattgaaaagccagttccaaaactctgttaatgaaagaaccaatgcatctgagtggataaatgtttctaaaataaaatagttcttgttaaagtgaaatttgaaaccacatgttaaatcaaaatgatcctttaaattagtatcactggtttttcatacctggaatcacatttcatgatacatttgggtgggtcctccctgcaaattttcaatgtttattcccaaagtcaaactcccattcatgtgaacaatacaggttagacagaggtaaggtcacattttacattacaactttgcaatattaatcaacctagtactttaaaggaatgattgaaaactatttgggaagataaaaaccagtttcaatgaagcaaacctattcctcatgaaacttaagatcagtcattttatcttcaatccacatttaatgaacaccaaccatgttgatttaatgcctactatgaccctgacagccacagtgcatctgacacttactttctccaaaacaactatgatttaaaccttgagtaaatcacttgaaccttgaggttagagttactatatttgctcaagatgacaaatgcaggtgctttcttttttaaagaaaaatgacactagatcattaacaccttgagtataggacaggtaattgcctctgtaattcccagcgtctagtgtagtgcctggtccatagaaagctctcaataagtgtttgattacatttaatctcagagctcccttccaagggatactgccaagaggtaaagctccaaacctctactcttactgagagcagaatttcttagaatttccagaaccatctcctatgcttaagtataaattcttgtcagacacagtggctcacacctgtaatcccgctacttgggaggcagaggtggggggaatcagcagaggtcaggaggtcaagaccagcctgggcaacatagtgagacccatctctaaacaaatgtttaaaaattagctaggcatgctggcacacacctgtagtcccagccatttcagaggctgatgcaggaggatcgtttaagtccaggagttcaaggctgcagtgagctataatcatgccactgcactccagccagggagacagctggaatccatgtcttataaacaataataattaatttttaaaaaaagtatttatcatccacaccaatcctggggaagctaacaatccacccttaacacatttcagttttaaaacctggctgatctggaatagaactttgtccaaattaaattgtagaaatgctatggattcaagagtaaacctgcttgattaatcaaacaagctggaaaactactgttaatttctttgttgtaaattgatcactgtaattttaccttacatgtcatttatattttgtatatacatgaacattttaatttccatagcttttaacaggttgacataatacttctccatgcagtaagtcagtcattttttccacttgtaactgtaattcaataaaatttaatcctgtctggtc

SEQ ID NO: 29157 - DNA, 3449 bp, Homo sapiens
tcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaag

SEQ ID NO: 29158 - DNA, 3142 bp, Homo sapiens
gcctccctgggatttggatcctggtttccagagctaagaacacaaagtcatgaaggtgaaggaggagaaggctggggtaggaaagctggaccacactaaccacaggaggagatttccggatcagaaagggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagttctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaag

SEQ ID NO: 29159 - DNA, 6041 bp, Homo sapiens
accctaaaggaattggagtcagggcccaggagccacaggccactgcactggggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagttctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaagcatcaccttgcacttcaaaatatcctgtccagcttcacctgctttcagctactcacggaacccagtgttcatggtgccacaggtgaagatagagatggagtcagactatgacttcacagacatggataaataccgaagagaaactgacagtgagaccaccctctaggatgaagcagcttctcccagatgggagatggagagcctggcttagtcttcactgggagggtcttaacttctctgtgcctgtttccttctttatcaaacagagggagtccgtctgcctatagaaaactggagatctattgatgaaaagtattgcttagatgcaaagctctcccctttgtagtaattaaaatacctaaagctaaatattatattttattttaaaatgcagttcagcatagaaattctaacatttctttggaaataaaaaaatgcttgtttccccaaaccatagctaagataaaggggcaatagtcaattcatatttaaaacaaatatcaatttaaaattgtttaaaggttagatttaaatatagatgttctcaaacaaacttgtaatatacttttatgtcactagaccatctttggaatatttggcaattctgcatattaagaaatgctgaaaaggtcctatcttttctccctgtcacatccaatttcctaagggttatatgaaaagtttgaaccagccgggcacagtggcacacgcctgtaatcctagcactttgggaggccgaggcaggtgaattgcctgagctcaggagttcgagaccagcctaggcaacacggtgaaaccccgtctctactaaactacaaaaaattagccgggtgtggtggcatgcacctgtagtcccagctattcgggaggctgaggcaggagaatcgcttgaacccaggaggcagaagttgcagtgagctgagatggcaccactgcactccagcctaggcaacagagtgagactccgtatccaaacaaaaaaaaagtttgaaccatctgcattatgggccttgctccagaagtgtgactggggctttcccagattgaaaagccagttccaaaactctgttaatgaaagaaccaatgcatctgagtggataaatgtttctaaaataaaatagttcttgttaaagtgaaatttgaaaccacatgttaaatcaaaatgatcctttaaattagtatcactggtttttcatacctggaatcacatttcatgatacatttgggtgggtcctccctgcaaattttcaatgtttattcccaaagtcaaactcccattcatgtgaacaatacaggttagacagaggtaaggtcacattttacattacaactttgcaatattaatcaacctagtactttaaaggaatgattgaaaactatttgggaagataaaaaccagtttcaatgaagcaaacctattcctcatgaaacttaagatcagtcattttatcttcaatccacatttaatgaacaccaaccatgttgatttaatgcctactatgaccctgacagccacagtgcatctgacacttactttctccaaaacaactatgatttaaaccttgagtaaatcacttgaaccttgaggttagagttactatatttgctcaagatgacaaatgcaggtgctttcttttttaaagaaaaatgacactagatcattaacaccttgagtataggacaggtaattgcctctgtaattcccagcgtctagtgtagtgcctggtccatagaaagctctcaataagtgtttgattacatttaatctcagagctcccttccaagggatactgccaagaggtaaagctccaaacctctactcttactgagagcagaatttcttagaatttccagaaccatctcctatgcttaagtataaattcttgtcagacacagtggctcacacctgtaatcccgctacttgggaggcagaggtggggggaatcagcagaggtcaggaggtcaagaccagcctgggcaacatagtgagacccatctctaaacaaatgtttaaaaattagctaggcatgctggcacacacctgtagtcccagccatttcagaggctgatgcaggaggatcgtttaagtccaggagttcaaggctgcagtgagctataatcatgccactgcactccagccagggagacagctggaatccatgtcttataaacaataataattaatttttaaaaaaagtatttatcatccacaccaatcctggggaagctaacaatccacccttaacacatttcagttttaaaacctggctgatctggaatagaactttgtccaaattaaattgtagaaatgctatggattcaagagtaaacctgcttgattaatcaaacaagctggaaaactactgttaatttctttgttgtaaattgatcactgtaattttaccttacatgtcatttatattttgtatatacatgaacattttaatttccatagcttttaacaggttgacataatacttctccatgcagtaagtcagtcattttttccacttgtaactgtaattcaataaaatttaatcctgtctggtc

SEQ ID NO: 29160 - DNA, 3123 bp, Homo sapiens
atgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctga

SEQ ID NO: 29161 - DNA, 3814 bp, Homo sapiens
ccaccctaaaggaattggagtcagggcccaggagccacaggccactgcactggggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctga

SEQ ID NO: 29162 - DNA, 6348 bp, Homo sapiens
accctaaaggaattggagtcagggcccaggagccacaggccactgcactggggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagttctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaagcatcaccttgcacttcaaaatatcctgtccagcttcacctgctttcagctactcacggaacccagtgttcatggtgccacaggtgaagatagagatggagtcagactatgacttcacagacatggataaataccgaagagaaactgacagtgagaccaccctctaggatgaagcagcttctcccagatgggagatggagagcctggcttagtcttcactgggagggtcttaacttctctgtgcctgtttccttctttatcaaacagagggagtccgtctgcctatagaaaactggagatctattgatgaaaagtattgcttagatgcaaagctctcccctttgtagtaattaaaatacctaaagctaaatattatattttattttaaaatgcagttcagcatagaaattctaacatttctttggaaataaaaaaatgcttgtttccccaaaccatagctaagataaaggggcaatagtcaattcatatttaaaacaaatatcaatttaaaattgtttaaaggttagatttaaatatagatgttctcaaacaaacttgtaatatacttttatgtcactagaccatctttggaatatttggcaattctgcatattaagaaatgctgaaaaggtcctatcttttctccctgtcacatccaatttcctaagggttatatgaaaagtttgaaccagccgggcacagtggcacacgcctgtaatcctagcactttgggaggccgaggcaggtgaattgcctgagctcaggagttcgagaccagcctaggcaacacggtgaaaccccgtctctactaaactacaaaaaattagccgggtgtggtggcatgcacctgtagtcccagctattcgggaggctgaggcaggagaatcgcttgaacccaggaggcagaagttgcagtgagctgagatggcaccactgcactccagcctaggcaacagagtgagactccgtatccaaacaaaaaaaaagtttgaaccatctgcattatgggccttgctccagaagtgtgactggggctttcccagattgaaaagccagttccaaaactctgttaatgaaagaaccaatgcatctgagtggataaatgtttctaaaataaaatagttcttgttaaagtgaaatttgaaaccacatgttaaatcaaaatgatcctttaaattagtatcactggtttttcatacctggaatcacatttcatgatacatttgggtgggtcctccctgcaaattttcaatgtttattcccaaagtcaaactcccattcatgtgaacaatacaggttagacagaggtaaggtcacattttacattacaactttgcaatattaatcaacctagtactttaaaggaatgattgaaaactatttgggaagataaaaaccagtttcaatgaagcaaacctattcctcatgaaacttaagatcagtcattttatcttcaatccacatttaatgaacaccaaccatgttgatttaatgcctactatgaccctgacagccacagtgcatctgacacttactttctccaaaacaactatgatttaaaccttgagtaaatcacttgaaccttgaggttagagttactatatttgctcaagatgacaaatgcaggtgctttcttttttaaagaaaaatgacactagatcattaacaccttgagtataggacaggtaattgcctctgtaattcccagcgtctagtgtagtgcctggtccatagaaagctctcaataagtgtttgattacatttaatctcagagctcccttccaagggatactgccaagaggtaaagctccaaacctctactcttactgagagcagaatttcttagaatttccagaaccatctcctatgcttaagtataaattcttgtcagacacagtggctcacacctgtaatcccgctacttgggaggcagaggtggggggaatcagcagaggtcaggaggtcaagaccagcctgggcaacatagtgagacccatctctaaacaaatgtttaaaaattagctaggcatgctggcacacacctgtagtcccagccatttcagaggctgatgcaggaggatcgtttaagtccaggagttcaaggctgcagtgagctataatcatgccactgcactccagccagggagacagctggaatccatgtcttataaacaataataattaatttttaaaaaaagtatttatcatccacaccaatcctggggaagctaacaatccacccttaacacatttcagttttaaaacctggctgatctggaatagaactttgtccaaattaaattgtagaaatgctatggattcaagagtaaacctgcttgattaatcaaacaagctggaaaactactgttaatttctttgttgtaaattgatcactgtaattttaccttacatgtcatttatattttgtatatacatgaacattttaatttccatagcttttaacaggttgacataatacttctccatgcagtaagtcagtcattttttccacttgtaactgtaattcaataaaatttaatcctgtctggtca

SEQ ID NO: 29163 - DNA, 6168 bp, Homo sapiens
accctaaaggaattggagtcagggcccaggagccacaggccactgcactggggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagttctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaagcatcaccttgcacttcaaaatatcctgtccagcttcacctgctttcagctactcacggaacccagtgttcatggtgccacaggtgaagatagagatggagtcagactatgacttcacagacatggataaataccgaagagaaactgacagtgagaccaccctctaggatgaagcagcttctcccagatgggagatggagagcctggcttagtcttcactgggagggtcttaacttctctgtgcctgtttccttctttatcaaacagagggagtccgtctgcctatagaaaactggagatctattgatgaaaagtattgcttagatgcaaagctctcccctttgtagtaattaaaatacctaaagctaaatattatattttattttaaaatgcagttcagcatagaaattctaacatttctttggaaataaaaaaatgcttgtttccccaaaccatagctaagataaaggggcaatagtcaattcatatttaaaacaaatatcaatttaaaattgtttaaaggttagatttaaatatagatgttctcaaacaaacttgtaatatacttttatgtcactagaccatctttggaatatttggcaattctgcatattaagaaatgctgaaaaggtcctatcttttctccctgtcacatccaatttcctaagggttatatgaaaagtttgaaccagccgggcacagtggcacacgcctgtaatcctagcactttgggaggccgaggcaggtgaattgcctgagctcaggagttcgagaccagcctaggcaacacggtgaaaccccgtctctactaaactacaaaaaattagccgggtgtggtggcatgcacctgtagtcccagctattcgggaggctgaggcaggagaatcgcttgaacccaggaggcagaagttgcagtgagctgagatggcaccactgcactccagcctaggcaacagagtgagactccgtatccaaacaaaaaaaaagtttgaaccatctgcattatgggccttgctccagaagtgtgactggggctttcccagattgaaaagccagttccaaaactctgttaatgaaagaaccaatgcatctgagtggataaatgtttctaaaataaaatagttcttgttaaagtgaaatttgaaaccacatgttaaatcaaaatgatcctttaaattagtatcactggtttttcatacctggaatcacatttcatgatacatttgggtgggtcctccctgcaaattttcaatgtttattcccaaagtcaaactcccattcatgtgaacaatacaggttagacagaggtaaggtcacattttacattacaactttgcaatattaatcaacctagtactttaaaggaatgattgaaaactatttgggaagataaaaaccagtttcaatgaagcaaacctattcctcatgaaacttaagatcagtcattttatcttcaatccacatttaatgaacaccaaccatgttgatttaatgcctactatgaccctgacagccacagtgcatctgacacttactttctccaaaacaactatgatttaaaccttgagtaaatcacttgaaccttgaggttagagttactatatttgctcaagatgacaaatgcaggtgctttcttttttaaagaaaaatgacactagatcattaacaccttgagtataggacaggtaattgcctctgtaattcccagcgtctagtgtagtgcctggtccatagaaagctctcaataagtgtttgattacatttaatctcagagctcccttccaagggatactgccaagaggtaaagctccaaacctctactcttactgagagcagaatttcttagaatttccagaaccatctcctatgcttaagtataaattcttgtcagacacagtggctcacacctgtaatcccgctacttgggaggcagaggtggggggaatcagcagaggtcaggaggtcaagaccagcctgggcaacatagtgagacccatctctaaacaaatgtttaaaaattagctaggcatgctggcacacacctgtagtcccagccatttcagaggctgatgcaggaggatcgtttaagtccaggagttcaaggctgcagtgagctataatcatgccactgcactccagccagggagacagctggaatccatgtcttataaacaataataattaatttttaaaaaaagtatttatcatccacaccaatcctggggaagctaacaatccacccttaacacatttcagttttaaaacctggctgatctggaatagaactttgtccaaattaaattgtagaaatgctatggattcaagagtaaacctgcttgattaatcaaacaagctggaaaactactgttaatttctttgttgtaaattgatcactgtaattttaccttacatgtcatttatattttgtatatacatgaacattttaatttccatagcttttaacaggttgacataatacttctccatgcagtaagtcagtcattttttccacttgtaactgtaattcaataaaatttaatcctgtctggtc

SEQ ID NO: 29164 - DNA, 3073 bp, Homo sapiens
tggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagttctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgtctctctccaccacagatcctgggcctcatcatcgttcgaaggcttctggatttcatcttttcccagcacgacctggcctggattgacaacatc

SEQ ID NO: 29165 - DNA, 727 bp, Homo sapiens
aaggtccaccctaaaggaattggagtcagggcccaggagccacaggccactgcactggggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtgtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaa

SEQ ID NO: 29166 - DNA, 552 bp, Homo sapiens
atactgttcagcctggaaaccacagagagcccttcttgccacccaacaggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaagg

SEQ ID NO: 29167 - DNA, 6410 bp, Homo sapiens
accctaaaggaattggagtcagggcccaggagccacaggccactgcactggggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgtctctctccaccacagatctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaagcatcaccttgcacttcaaaatatcctgtccagcttcacctgctttcagctactcacggaacccagtgttcatggtgccacaggtgaagatagagatggagtcagactatgacttcacagacatggataaataccgaagagaaactgacagtgagaccaccctctaggatgaagcagcttctcccagatgggagatggagagcctggcttagtcttcactgggagggtcttaacttctctgtgcctgtttccttctttatcaaacagagggagtccgtctgcctatagaaaactggagatctattgatgaaaagtattgcttagatgcaaagctctcccctttgtagtaattaaaatacctaaagctaaatattatattttattttaaaatgcagttcagcatagaaattctaacatttctttggaaataaaaaaatgcttgtttccccaaaccatagctaagataaaggggcaatagtcaattcatatttaaaacaaatatcaatttaaaattgtttaaaggttagatttaaatatagatgttctcaaacaaacttgtaatatacttttatgtcactagaccatctttggaatatttggcaattctgcatattaagaaatgctgaaaaggtcctatcttttctccctgtcacatccaatttcctaagggttatatgaaaagtttgaaccagccgggcacagtggcacacgcctgtaatcctagcactttgggaggccgaggcaggtgaattgcctgagctcaggagttcgagaccagcctaggcaacacggtgaaaccccgtctctactaaactacaaaaaattagccgggtgtggtggcatgcacctgtagtcccagctattcgggaggctgaggcaggagaatcgcttgaacccaggaggcagaagttgcagtgagctgagatggcaccactgcactccagcctaggcaacagagtgagactccgtatccaaacaaaaaaaaagtttgaaccatctgcattatgggccttgctccagaagtgtgactggggctttcccagattgaaaagccagttccaaaactctgttaatgaaagaaccaatgcatctgagtggataaatgtttctaaaataaaatagttcttgttaaagtgaaatttgaaaccacatgttaaatcaaaatgatcctttaaattagtatcactggtttttcatacctggaatcacatttcatgatacatttgggtgggtcctccctgcaaattttcaatgtttattcccaaagtcaaactcccattcatgtgaacaatacaggttagacagaggtaaggtcacattttacattacaactttgcaatattaatcaacctagtactttaaaggaatgattgaaaactatttgggaagataaaaaccagtttcaatgaagcaaacctattcctcatgaaacttaagatcagtcattttatcttcaatccacatttaatgaacaccaaccatgttgatttaatgcctactatgaccctgacagccacagtgcatctgacacttactttctccaaaacaactatgatttaaaccttgagtaaatcacttgaaccttgaggttagagttactatatttgctcaagatgacaaatgcaggtgctttcttttttaaagaaaaatgacactagatcattaacaccttgagtataggacaggtaattgcctctgtaattcccagcgtctagtgtagtgcctggtccatagaaagctctcaataagtgtttgattacatttaatctcagagctcccttccaagggatactgccaagaggtaaagctccaaacctctactcttactgagagcagaatttcttagaatttccagaaccatctcctatgcttaagtataaattcttgtcagacacagtggctcacacctgtaatcccgctacttgggaggcagaggtggggggaatcagcagaggtcaggaggtcaagaccagcctgggcaacatagtgagacccatctctaaacaaatgtttaaaaattagctaggcatgctggcacacacctgtagtcccagccatttcagaggctgatgcaggaggatcgtttaagtccaggagttcaaggctgcagtgagctataatcatgccactgcactccagccagggagacagctggaatccatgtcttataaacaataataattaatttttaaaaaaagtatttatcatccacaccaatcctggggaagctaacaatccacccttaacacatttcagttttaaaacctggctgatctggaatagaactttgtccaaattaaattgtagaaatgctatggattcaagagtaaacctgcttgattaatcaaacaagctggaaaactactgttaatttctttgttgtaaattgatcactgtaattttaccttacatgtcatttatattttgtatatacatgaacattttaatttccatagcttttaacaggttgacataatacttctccatgcagtaagtcagtcattttttccacttgtaactgtaattcaataaaatttaatcctgtctggtc

SEQ ID NO: 29168 - DNA, 7757 bp, Homo sapiens
ctcactgtccctggaatcttcaagggagttactgcattacatcatcagaaacaaggcatttctatattactatggaaagatttcgtctggagaagaagttacctggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggggaaggcctttcagcctcccgccactctttgcgaacaggtctgtctgcctcaaacctttccttgagaggagaatcacctttatctcttcttcttggtcatcttcttccttcttcaagagctggaacccctgcaggctcaaggtgtacaaccccagtacccacccctcaaaacagtcctccttctagccctagcatcagccgcctgacctccagaagttcccaagagagtcagcgtcaggccccagaactactggtttcacctgccagtgatgatattcccacagtagtaattcatccgcctgaggaagacttagaagcagcgctgaaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgtaggactggatgaatggggttgtgaaactgatttgacaagagaataatttacaaaaatcaaatgagtattgagaagccacagaaatatcaaaaatggtgacatcactattaggatgaaaattttatgaaattccaatgctccctttaaccatataattaaattacaaaggtatacataattaatctaataaaggatcatgaggaatgccaaaagctgaaattttagcaagtctggtgttttaaattcattataaactatttattaactaatgtaatgtcctcctctaagaccatattgtaagagtcttgttaaaatgatggattcaacttctgcctcggatgagaggttggaaatgtagctgcttttctttagaaaatatgtagctgtcatcatttggtactgcctaaaaagagttagactctattggcaattgatagagtattacccacggtgcttattattgtttatgagcttccattgtaatgattcctttttatttgtagcagcataattatttccaaagaccccagtatttgctgctatttttaaaactcccctgatgtacctgaacaagaggatttcctcacatcatttccttgtgtctggacatcaggggtaacaactgtacttactttacaggaagaaattttaaaactgaaaactacctgggatcatagtgtttctgtgattttatttaattgtgtatagtaattatccagtgccagaaaaaccgtcacttgcaaaatactttgcactcaaaatgtttttacaatgcttctaaatgttactggtttctgctttcttttgactacttgactgacaaaatgatctgactactccatttaagagcaaaggtaactcatgtttaggtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataaatgtgctcagcagtttaacatgtgaatcctgttttaaagtgctcagatttcaactgtgtaagccattgatataacgctgtaattaaaaatgtttatatgaaataacttaatgttttaaatttatttatgtagatcacatcatttttatcgtatgcagtgcaaatatgtgaaatgtcttttggtttattccaacaattatttattttagaaagtaagtttaaagactttaaggacattcaaagtttaaaatagtgttcaaattgcaaaatttggcaatcttcatataaattggtttcttttctaacttttcaaaaactaacattaaatgtcaattataggaaaacatagttggaaatgtaatcatccaaagatcatttttaaaatgaaatttaattagcacatattgaacatttgacttaattgttaaaccccagttttgttttgtttttttaatcagatttttgcacactgattagtttttgtgttgtggcttttgttgctttattattcaaggttttttttttttttcttccccatgggggagattgtcttccaatgtttaactacgtttaaataaataaaaattgaattttattgttcatttatataaaatctgataccttgatgtaatttcacaatacagttccaatttttatggcttttataattacaatgatattttcttctataataaaatccaaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagcaataaaagtctacttaatta

SEQ ID NO: 29169 - DNA, 4001 bp, Homo sapiens
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccgggtaacgagcaggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggggaaggcctttcagcctcccgccactctttgcgaacaggtctgtctgcctcaaacctttccttgagaggagaatcacctttatctcttcttcttggtcatcttcttccttcttcaagagctggaacccctgcaggctcaaggtgtacaaccccagtacccacccctcaaaacagtcctccttctagccctagcatcagccgcctgacctccagaagttcccaagagagtcagcgtcaggccccagaactactggtttcacctgccagtgatgatattcccacagtagtaattcatccgcctgaggaagacttagaagcagcgctgaaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtgttgatccctcaattgttaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 29170 - DNA, 3933 bp, Homo sapiens
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggggaaggcctttcagcctcccgccactctttgcgaacaggtctgtctgcctcaaacctttccttgagaggagaatcacctttatctcttcttcttggtcatcttcttccttcttcaagagctggaacccctgcaggctcaaggtgtacaaccccagtacccacccctcaaaacagtcctccttctagccctagcatcagccgcctgacctccagaagttcccaagagagtcagcgtcaggccccagaactactggtttcacctgccagtgatgatattcccacagtagtaattcatccgcctgaggaagacttagaagcagcgctgaaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacgagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtgttgatccctcaattgttaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 29171 - DNA, 7385 bp, Homo sapiens
ctcactgtccctggaatcttcaagggagttactgcattacatcatcagaaacaaggcatttctatattactatggaaagatttcgtctggagaagaagttacctggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgtaggactggatgaatggggttgtgaaactgatttgacaagagaataatttacaaaaatcaaatgagtattgagaagccacagaaatatcaaaaatggtgacatcactattaggatgaaaattttatgaaattccaatgctccctttaaccatataattaaattacaaaggtatacataattaatctaataaaggatcatgaggaatgccaaaagctgaaattttagcaagtctggtgttttaaattcattataaactatttattaactaatgtaatgtcctcctctaagaccatattgtaagagtcttgttaaaatgatggattcaacttctgcctcggatgagaggttggaaatgtagctgcttttctttagaaaatatgtagctgtcatcatttggtactgcctaaaaagagttagactctattggcaattgatagagtattacccacggtgcttattattgtttatgagcttccattgtaatgattcctttttatttgtagcagcataattatttccaaagaccccagtatttgctgctatttttaaaactcccctgatgtacctgaacaagaggatttcctcacatcatttccttgtgtctggacatcaggggtaacaactgtacttactttacaggaagaaattttaaaactgaaaactacctgggatcatagtgtttctgtgattttatttaattgtgtatagtaattatccagtgccagaaaaaccgtcacttgcaaaatactttgcactcaaaatgtttttacaatgcttctaaatgttactggtttctgctttcttttgactacttgactgacaaaatgatctgactactccatttaagagcaaaggtaactcatgtttaggtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataaatgtgctcagcagtttaacatgtgaatcctgttttaaagtgctcagatttcaactgtgtaagccattgatataacgctgtaattaaaaatgtttatatgaaataacttaatgttttaaatttatttatgtagatcacatcatttttatcgtatgcagtgcaaatatgtgaaatgtcttttggtttattccaacaattatttattttagaaagtaagtttaaagactttaaggacattcaaagtttaaaatagtgttcaaattgcaaaatttggcaatcttcatataaattggtttcttttctaacttttcaaaaactaacattaaatgtcaattataggaaaacatagttggaaatgtaatcatccaaagatcatttttaaaatgaaatttaattagcacatattgaacatttgacttaattgttaaaccccagttttgttttgtttttttaatcagatttttgcacactgattagtttttgtgttgtggcttttgttgctttattattcaaggttttttttttttttcttccccatgggggagattgtcttccaatgtttaactacgtttaaataaataaaaattgaattttattgttcatttatataaaatctgataccttgatgtaatttcacaatacagttccaatttttatggcttttataattacaatgatattttcttctataataaaatccaaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagcaataaaagtctacttaatta

SEQ ID NO: 29172 - DNA, 3787 bp, Homo sapiens
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccgggtaacgagcaggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtgttgatccctcaattgttaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 29173 - DNA, 3667 bp, Homo sapiens
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 29174 - DNA, 3407 bp, Homo sapiens
gctctcctccttcccgctcggtccgccggttcgctcagttctagcttcaggttccacgccgcggcctcgctctcctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacgagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatag

SEQ ID NO: 29175 - DNA, 3825 bp, Homo sapiens
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggggaaggcctttcagcctcccgccactctttgcgaacaggtctgtctgcctcaaacctttccttgagaggagaatcacctttatctcttcttcttggtcatcttcttccttcttcaagagctggaacccctgcaggctcaaggtgtacaaccccagtacccacccctcaaaacagtcctccttctagccctagcatcagccgcctgacctccagaagttcccaagagagtcagcgtcaggccccagaactactggtttcacctgccagtgatgatattcccacagtagtaattcatccgcctgaggaagacttagaagcagcgctgaaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacgagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 29176 - DNA, 4120 bp, Homo sapiens
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccgggtaacgagcaggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggggaaggcctttcagcctcccgccactctttgcgaacaggtctgtctgcctcaaacctttccttgagaggagaatcacctttatctcttcttcttggtcatcttcttccttcttcaagagctggaacccctgcaggctcaaggtgtacaaccccagtacccacccctcaaaacagtcctccttctagccctagcatcagccgcctgacctccagaagttcccaagagagtcagcgtcaggccccagaactactggtttcacctgccagtgatgatattcccacagtagtaattcatccgcctgaggaagacttagaagcagcgctgaaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtgttgatccctcaattgttaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 29177 - DNA, 4159 bp, Homo sapiens
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccgggtaacgagcaggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggggaaggcctttcagcctcccgccactctttgcgaacaggtctgtctgcctcaaacctttccttgagaggagaatcacctttatctcttcttcttggtcatcttcttccttcttcaagagctggaacccctgcaggctcaaggtgtacaaccccagtacccacccctcaaaacagtcctccttctagccctagcatcagccgcctgacctccagaagttcccaagagagtcagcgtcaggccccagaactactggtttcacctgccagtgatgatattcccacagtagtaattcatccgcctgaggaagacttagaagcagcgctgaaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtgttgatccctcaattgttaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 29178 - DNA, 3775 bp, Homo sapiens
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtgttgatccctcaattgttaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 29179 - DNA, 3600 bp, Homo sapiens
cctactaaagccagcccagcagtcgcagcgcgcacacgcacgccccgcgtctcccgcgcccggcgcccggctctccccacgcgcgcacacctcgcgcacggacgcacccacgtttgtcctcgcgcgccgggggctcggcggcggcggcaggggcagcggcagaagcaggcagaccgcgcggggcagtaccgtagcggccgtcacgggctggccggccggccatggaggctgatggggccggcgagcagatgagaccgctactcacccggggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacgagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtgttgatccctcaattgttaacatatcagatgaaatggccaaaactgcacagtggaaggcactttccatgaatactgagaatgccaaagtaaccagatctaacatgagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagact

SEQ ID NO: 29180 - DNA, 3834 bp, Homo sapiens
tagttcggctccgccatgccggccgccgggagtaacgagccggacggcgtcctcagctatcagagaccagatgaagaagctgtggtggatcagggtgggaccagtacaattctcaacattcactatgaaaaagaagagctggaaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacgacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgaatgccaggagatgcatggagagttcatgggatctgcgtgcggccatcatggaccctacactcctgatgtcctcttttggtcctgtattctctttttcaccaccttcatcctctcaagcaccttaaagacgtttaagacgagccgttatttcccaaccagagtacgctccatggtgagtgactttgctgttttcctcactatcttcacaatggtgattattgattttttgattggagtcccatcaccaaagcttcaagttcccagtgtgttcaagccaacaagggatgatcgcggatggattattaatcccattggccccaatccctggtggactgtgatagctgcaattatcccagctcttctctgtactatcttgatattcatggatcagcagatcacagccgtcattattaacaggaaggaacataagctcaagaaaggctgtggctaccacctggacctactgatggtggccatcatgctgggtgtctgctccatcatgggcctgccctggtttgtagctgcaactgtcttgtccatcacacatgtgaacagcctcaagctagaatctgaatgctctgctcctggagaacagcccaagttcctgggcatccgagaacagagagtgacaggccttatgatctttgtgctgatgggctgctcagtcttcatgacggctatcttaaagtttattccaatgccagtactctacggagttttcctttacatgggagtttcttcactacagggaattcagttctttgatcgtctaaagctctttgggatgcccgcaaagcaccagccagatttcatctacctgcggcatgtgccgctgcgcaaagtgcacctcttcaccctcatccagttgacctgtctcgtcctgctctgggtcatcaaggcatctccagctgccattgttttcccaatgatggttttggccttggtctttgtcaggaaagtcatggatctctgtttctctaagcgagagctgagctggctagatgatctcatgcctgaaagcaaaaagaagaagttggatgatgccaaaaagaaggccaaggaggaagaggtcatagtccttgcaccaactgtatacctgggggcctcaaattacagaacataggaagggtcatgtgaaaagtcagcatgtctggaatcccgagggttatatttaggagctgggaagattacccccaaagatgttctcagctaagaatggattagggattcttgcttctgtctgttcttaatttttgggtttgacaaccacttattttttcctttgtttacaatctactcaccaggctcatacctacaatgtgaacatacagtatgcccttattagcagattcaatggctcacattctttcaaaaggtctaatttgacaaatacataagacccattatttcctagaatgtttgtaatatatctaattgcaaatggtgctgtggttggcaccatgcaaagataacttgcataggactttctgtcttttttcatttccctcagcacttggcatcttgtcatctacacaatggaccctcaataaatggcctatatgtgcaaagaaagaatgtgtagcaaatgaaaataccagaccaagaaatgagtgagctgggaagtgtttccaaatacagttagtgcctaaaatagtgtcctttgaaaaaacttttaaaagacttttttttaggccaggcataatgggttatccctgtaattccagggcttttgggagttgaagctggaggattacttgaggccagaagtttgagactagcctaggcaatataatgagaccctgtctct

SEQ ID NO: 29181 - DNA, 3900 bp, Homo sapiens
atgttcaacaagaacaacagcaacaaactcagaagcactcctcgctaccgccggggagacccaggatacctaaactttactgagttggggccactcaagcctgaacagaaggatcagtggagccaacatagaccagatgaagaagctgtggtggatcagggtgggaccagtacaattctcaacattcactatgaaaaagaagagctggaaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacgacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgaatgccaggagatgcatggagagttcatgggatctgcgtgcggccatcatggaccctacactcctgatgtcctcttttggtcctgtattctctttttcaccaccttcatcctctcaagcaccttaaagacgtttaagacgagccgttatttcccaaccagagtacgctccatggtgagtgactttgctgttttcctcactatcttcacaatggtgattattgattttttgattggagtcccatcaccaaagcttcaagttcccagtgtgttcaagccaacaagggatgatcgcggatggattattaatcccattggccccaatccctggtggactgtgatagctgcaattatcccagctcttctctgtactatcttgatattcatggatcagcagatcacagccgtcattattaacaggaaggaacataagctcaagaaaggctgtggctaccacctggacctactgatggtggccatcatgctgggtgtctgctccatcatgggcctgccctggtttgtagctgcaactgtcttgtccatcacacatgtgaacagcctcaagctagaatctgaatgctctgctcctggagaacagcccaagttcctgggcatccgagaacagagagtgacaggccttatgatctttgtgctgatgggctgctcagtcttcatgacggctatcttaaagtttattccaatgccagtactctacggagttttcctttacatgggagtttcttcactacagggaattcagttctttgatcgtctaaagctctttgggatgcccgcaaagcaccagccagatttcatctacctgcggcatgtgccgctgcgcaaagtgcacctcttcaccctcatccagttgacctgtctcgtcctgctctgggtcatcaaggcatctccagctgccattgttttcccaatgatggttttggccttggtctttgtcaggaaagtcatggatctctgtttctctaagcgagagctgagctggctagatgatctcatgcctgaaagcaaaaagaagaagttggatgatgccaaaaagaaggccaaggaggaagaggtcatagtccttgcaccaactgtatacctgggggcctcaaattacagaacataggaagggtcatgtgaaaagtcagcatgtctggaatcccgagggttatatttaggagctgggaagattacccccaaagatgttctcagctaagaatggattagggattcttgcttctgtctgttcttaatttttgggtttgacaaccacttattttttcctttgtttacaatctactcaccaggctcatacctacaatgtgaacatacagtatgcccttattagcagattcaatggctcacattctttcaaaaggtctaatttgacaaatacataagacccattatttcctagaatgtttgtaatatatctaattgcaaatggtgctgtggttggcaccatgcaaagataacttgcataggactttctgtcttttttcatttccctcagcacttggcatcttgtcatctacacaatggaccctcaataaatggcctatatgtgcaaagaaagaatgtgtagcaaatgaaaataccagaccaagaaatgagtgagctgggaagtgtttccaaatacagttagtgcctaaaatagtgtcctttgaaaaaacttttaaaagacttttttttaggccaggcataatgggttatccctgtaattccagggcttttgggagttgaagctggaggattacttgaggccagaagtttgagactagcctaggcaatataatgagaccctgtctct

SEQ ID NO: 29182 - DNA, 2581 bp, Homo sapiens
attggttgcggcggatgcctcgcgggccggtggctatggaggcggcggcggttgatggttgaccgttggctccggggtgggggtcgccgttcgagtgatctgctcagacccgaccagagggcgcgggctgctgatgcttggcttggagcccgtgggggagacctagttcggctccgccatgccggccgccgggagtaacgagccggacggcgtcctcagctatcagagaccagatgaagaagctgtggtggatcagggtgggaccagtacaattctcaacattcactatgaaaaagaagagctggaaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacgacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgaatgccaggagatgcatggagagttcatgggatctgcgtgcggccatcatggaccctacactcctgatgtcctcttttggtcctgtattctctttttcaccaccttcatcctctcaagcaccttaaagacgtttaagacgagccgttatttcccaaccagaatggagtcttgctctgtcgcctggctggagtgcggtggtgtgatcttggctcactgcaacctccgcctcctcccgagtagctgggactacaggcacgcaccaccacagccagctaatttttgtatttttagtagagacggggtttccccatgttggccaggatggtctcaatctcttgacctcgtgatctgcctgcctcggcctcccaaaatgctgggattacaagcatga

SEQ ID NO: 29183 - DNA, 4395 bp, Homo sapiens
gtgctccgcgccctgattggctgcgcaggcctctcgctgattggttgcggcggatgcctcgcgggccggtggctatggaggcggcggcggttgatggttgaccgttggctccggggtgggggtcgccgttcgagtgatctgctcagacccgaccagagggcgcgggctgctgatgcttggcttggagcccgtgggggagacctagttcggctccgccatgccggccgccgggagtaacgagccggacggcgtcctcagctatcagagaccagatgaagaagctgtggtggatcagggtgggaccagtacaattctcaacattcactatgaaaaagaagagctggaaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacgacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgaatgccaggagatgcatggagagttcatgggatctgcgtgcggccatcatggaccctacactcctgatgtcctcttttggtcctgtattctctttttcaccaccttcatcctctcaagcaccttaaagacgtttaagacgagccgttatttcccaaccagagtacgctccatggtgagtgactttgctgttttcctcactatcttcacaatggtgattattgattttttgattggagtcccatcaccaaagcttcaagttcccagtgtgttcaagccaacaagggatgatcgcggatggattattaatcccattggccccaatccctggtggactgtgatagctgcaattatcccagctcttctctgtactatcttgatattcatggatcagcagatcacagccgtcattattaacaggaaggaacataagctcaagaaaggctgtggctaccacctggacctactgatggtggccatcatgctgggtgtctgctccatcatgggcctgccctggtttgtagctgcaactgtcttgtccatcacacatgtgaacagcctcaagctagaatctgaatgctctgctcctggagaacagcccaagttcctgggcatccgagaacagagagtgacaggccttatgatctttgtgctgatgggctgctcagtcttcatgacggctatcttaaagtttattccaatgccagtactctacggagttttcctttacatgggagtttcttcactacagggaattcagttctttgatcgtctaaagctctttgggatgcccgcaaagcaccagccagatttcatctacctgcggcatgtgccgctgcgcaaagtgcacctcttcaccctcatccagttgacctgtctcgtcctgctctgggtcatcaaggcatctccagctgccattgttttcccaatgatggttttggccttggtctttgtcaggaaagtcatggatctctgtttctctaagcgagagctgagctggctagatgatctcatgcctgaaagcaaaaagaagaagttggatgatgccaaaaagaaggccaaggaggaagaggaggctgagaaaatgttagaaattgggggagacaagtttcccttagagagcaggaagttactaagtagtcctggaaagaacatcagttgcagatgtgacccctctgagattaatatatctgatgaaatgcctaaaactacagtttggaaagctctcagtatgaattctggaaatgcaaaggaaaagagtctcttcaactaagagtctttgctgggatggaagatttgggccgtgtggtgcctcagggaagttctggttacagagaaaatggcgagtctctcagagaagaagcaagaccaagtctggccctgtccttggtcatctcaaagccatgccgaagcattcagttattcttggtgtgcattggaaggcatccagctatccccataccagcagccagtcaccagatgtgaatgtggaagcagaagaccacctcctgttggttcttctcctcttccttctttttctctttagaacggccaccattgaagacctagcttcccattttccagacgttttctctgaaattctctgctggcctgccaagccatatggattcattctgccactgaggagtccttcagtgaggtccctcttcctaaaggacagagtggggagtaggaggggaacagagaggacatcctctctggctctccagtgctcttagtgtctacaggctcctaggcagccctgggccttggtttgattacctcccctgggggatgctggtcagacccagaggttgtcaggaggtcagctaccaggaagatccatgatctgggcattggcagtgcctgccaccacagccaggaagatgcctctgacctgggtgcatctccatcactccttagcagcagcctgcataactggcaagaatcttggatgatacaagagccaagaagggacatttgagttgtgtcgcttagataggaaagggatccagggaaaatcaacagtaagtgaggatgagcagtgtctcttggttttcattgaggatagagtaagagattgagtttagattgcaacagaaggaattagtttagataccaggaagaacttcctagcctgaagatttgtcatagtgtctgctttctaga

SEQ ID NO: 29184 - DNA, 2255 bp, Homo sapiens
attcatctcgtaagcgccaaggtggaggggggtcctaccgagggaggagctacaggccaccgcgaccagcagagagcgaaggcaggagggaccagcctggcccagccccttcattttactgtcgggggtagtgaggaggaagaggaagaggcgaaggctggcggaggaggagagaccagatgaagaagctgtggtggatcagggtgggaccagtacaattctcaacattcactatgaaaaagaagagctggaaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacgacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgtaagtctgggagctgccagatgtcctagcattgtgaccacaggtttaggagggacttctaagtgaaggggaggagtagccctttggccaaactctggcatttaccgaaataaagcttttt

SEQ ID NO: 29185 - DNA, 4005 bp, Homo sapiens
agaccagatgaagaagctgtggtggatcagggtgggaccagtacaattctcaacattcactatgaaaaagaagagctggaagtcttcacaagatccctgtgaagtttgcaggcatgtgcaggacaaaggaagagaccttcaactccaaaatctctatatctttactcctggaagtctttgaagttttgttgttccagagctgtgaccagaccaaagaactgtgatatttttttctcttaactatgctaggctttttgttgttgttgttttttaaaactaaaggagttctctccacagaccttctgcttctttccaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacgacacaccatctcagcgtgttcagttcattcttggcaccgaggaagatgaagagcatgtgcctcatgagctgtttacagagctggatgagatctgtatgaaagagggagaagatgctgagtggaaggaaacagccaggtggctgaagtttgaagaagatgttgaagatgggggagaacgctggagcaagccttatgtggcaaccctttcattgcacagcctgtttgagctaaggagctgccttattaatggaacagtcctcctggatatgcatgcaaatagcatagaagaaatttcagacctgatcctggatcagcaagaactgtccagtgacctgaatgacagcatgagggttaaagtgcgggaagcccttctcaaaaagcatcatcatcagaatgaaaagaagagaaacaacctcattcccattgttcgctcctttgctgaggttggcaagaagcagtctgatcctcatttgatggataaacatggtcaaaccgtgtctcctcagtctgttccaactacaaatcttgaagtaaaaaatggagtgaattgtgaacatagtcctgtggatttaagcaaggtagaccttcatttcatgaaaaaaattcctactggggccgaggcctccaatgtcctggttggagaggtggatattttggaccgtcccattgttgcctttgtgaggctgtctccagctgttcttctctcaggcctaacagaagtgccaatcccaacaagatttttgtttatcttattgggtccagtagggaaaggtcagcagtaccatgagattggcagatccatggccaccatcatgacagatgagatttttcatgacgtagcatataaggcaaaagagcgagatgatctcctggcggggattgatgagttcctagaccaggtgacggtgctccctccaggagagtgggatccctccattagaattgagccacccaaaaatgtcccttcccaggagaaaaggaaaatgcctggagttccaaatggaaatgtttgccacatagaacaggaaccacatgggggtcacagtgggccagaacttcagcgcactgggcggctatttgggggcttggtgctggacatcaagcggaaggccccctggtactggagcgactaccgagatgcactcagcttacagtgtttggcttcctttctgttcctgtactgtgcctgcatgtcacctgtcatcacctttgggggactgcttggagaagccactgagggacgcataagtgcaattgaatccttgtttggagcttccatgactgggattgcttattccttgtttgcgggacaggctctcaccatcctgggaagtactggaccagtgcttgtgtttgaaaagattttgttcaaattctgcaaagactatgctctttcatacctctccctgcgagcttgtattggactgtggaccgctttcctgtgtattgtccttgtggcaactgatgccagttcccttgtctgctacattacccgtttcactgaagaagcatttgcctccctaatttgcattattttcatctatgaagcaatagaaaaactgattcacctggcagagacctaccccatccacatgcacagccagctggaccaccttagcctctattactgcaggtgtactctgccagagaatccaaacaatcacaccctccagtactggaaggaccacaacatcgtgacagcagaagtccactgggctaacctgactgtcagtgaatgccaggagatgcatggagagttcatgggatctgcgtgcggccatcatggaccctacactcctgatgtcctcttttggtcctgtattctctttttcaccaccttcatcctctcaagcaccttaaagacgtttaagacgagccgttatttcccaaccagagtacgctccatggtgagtgactttgctgttttcctcactatcttcacaatggtgattattgattttttgattggagtcccatcaccaaagcttcaagttcccagtgtgttcaagccaacaagggatgatcgcggatggattattaatcccattggccccaatccctggtggactgtgatagctgcaattatcccagctcttctctgtactatcttgatattcatggatcagcagatcacagccgtcattattaacaggaaggaacataagctcaagaaaggctgtggctaccacctggacctactgatggtggccatcatgctgggtgtctgctccatcatgggcctgccctggtttgtagctgcaactgtcttgtccatcacacatgtgaacagcctcaagctagaatctgaatgctctgctcctggagaacagcccaagttcctgggcatccgagaacagagagtgacaggccttatgatctttgtgctgatgggctgctcagtcttcatgacggctatcttaaagtttattccaatgccagtactctacggagttttcctttacatgggagtttcttcactacagggaattcagttctttgatcgtctaaagctctttgggatgcccgcaaagcaccagccagatttcatctacctgcggcatgtgccgctgcgcaaagtgcacctcttcaccctcatccagttgacctgtctcgtcctgctctgggtcatcaaggcatctccagctgccattgttttcccaatgatggttttggccttggtctttgtcaggaaagtcatggatctctgtttctctaagcgagagctgagctggctagatgatctcatgcctgaaagcaaaaagaagaagttggatgatgccaaaaagaaggccaaggaggaagaggtcatagtccttgcaccaactgtatacctgggggcctcaaattacagaacataggaagggtcatgtgaaaagtcagcatgtctggaatcccgagggttatatttaggagctgggaagattacccccaaagatgttctcagctaagaatggattagggattcttgcttctgtctgttcttaatttttgggtttgacaaccacttattttttcctttgtttacaatctactcaccaggctcatacctacaatgtgaacatacagtatgcccttattagcagattcaatggctcacattctttcaaaaggtctaatttgacaaatacataagacccattatttcctagaatgtttgtaatatatctaattgcaaatggtgctgtggttggcaccatgcaaagataacttgcataggactttctgtcttttttcatttccctcagcacttggcatcttgtcatctacacaatggaccctcaataaatggcctatatgtgcaaagaaagaatgtgtagcaaatgaaaataccagaccaagaaatgagtgagctgggaagtgtttccaaatacagttagtgcctaaaatagtgtcctttgaaaaaacttttaaaagacttttttttaggccaggcataatgggttatccctgtaattccagggcttttgggagttgaagctggaggattacttgaggccagaagtttgagactagcctaggcaatataatgagaccctgtctct

SEQ ID NO: 29186 - DNA, 3414 bp, Homo sapiens
gatccgaatactaagcagagcgagtgccgggctgagtgtaagacactgaagacactgcagagcaaggtgcttattccagaggcgttacaaaacatggagattaaagaccagggagcccaaatggagccgctgctgcctacgagaaatgatgaagaagcagttgtggatagaggtggaactcgttctattctcaaaacacactttgagaaagaagatttagaaggtcatcgaacactatttattggagtacatgtgcccttgggaggaagaaaaagccatcgacgtcacaggcatcgtggtcataaacacagaaagagagacagagaaagagattcaggattagaggatggaagggagtcaccttcttttgacaccccatcacagagggtacagtttattcttggaaccgaggatgatgacgaggaacacattcctcatgaccttttcacagaactggatgagatttgttggcgtgaaggtgaggacgctgagtggcgagaaacagccaggtggttgaagtttgaagaagatgtggaagatggaggagaaaggtggagcaagccttatgtggctactctttcattgcacagcttgtttgaattgagaagttgtattctgaatggaactgtgttgctggacatgcatgccaacactttagaagaaattgcagatatggttcttgaccaacaagtgagctcaggtcagctgaatgaagatgtacgccatagggtccatgaggcattgatgaaacagcatcatcatcagaatcagaaaaaactcaccaacaggattcccattgttcgttcctttgctgatattggcaagaaacagtcagaaccaaattccatggacaaaaatgcaggtcaggttgtttctcctcagtctgctccagcctgtgttgaaaataaaaatgatgttagcagagaaaacagcactgttgactttagcaaggttgatctgcattttatgaaaaagattcctccaggtgctgaagcatcgaacatcttagtgggagaactggagttcttggatcgaacagtagttgcgtttgtcaggttgtctccagctgtattgcttcaaggactggctgaagtcccaatcccaaccagatttttgttcattcttctgggacccctgggaaagggtcaacagtaccatgagattggcagatcaattgcaaccctaatgacagatgaggtatttcatgatgttgcctataaagctaaagatcgtaatgacttggtatcaggaattgatgagtttctggatcaggttactgttctccctcctggagaatgggatccaagcattcgaatagagcctcccaaaaatgttccttcccaggagaagaggaagattcctgctgtaccaaatggaacagcagctcatggggaagcagagccccacggaggacatagtggacctgaactccagcgaactggaaggatttttgggggacttattttagatatcaaaagaaaagctccatacttctggagtgacttcagagatgctttcagcctgcagtgcttagcatcttttctatttctctactgcgcgtgtatgtctcctgtcatcacgtttggaggactgctgggagaagcaactgaagggcgtataagtgcaattgaatctctctttggagcatccatgaccgggatagcctattctctctttggtggacagcctcttaccatattaggcagtacaggaccagttttggtgtttgaaaagattttgtttaaattttgcaaagaatatgggctgtcatacctatctttaagagctagcattggactttggactgcaactctatgtatcatacttgtggccacagatgctagttcccttgtctgctacatcactcggtttactgaagaagcttttgcttccctgatttgcatcattttcatttatgaggccctggagaagttgtttgaactcagtgaagcatatccaatcaacatgcataatgatctggaactgctgacacaatactcgtgtaactgtgtggaaccgcataatcccagcaatggcacattgaaggaatggagggaatccaatatttctgcctctgacataatttgggagaacctaactgtgtcagaatgcaaatcattgcatggagagtatgttggacgggcctgtggccatgatcacccatatgttccagatgttctattttggtctgtgatcctgttcttttccacagttactctgtcagccaccctgaagcagttcaagactagcagatattttccaaccaaggttcgatccatagtgagtgactttgctgtctttcttacaattctgtgtatggttttaattgactatgccattgggatcccatctccaaaactacaagtaccaagtgttttcaagcccactagagatgatcgtggctggtttgttacgcctttaggtccaaacccatggtggacagtaatagctgctataattccagctctgctttgtactattctaatttttatggaccaacagattacagctgtcatcatcaacaggaaagagcataagctaaagaaaggttgtgggtaccatctggacctattaatggtggctgtcatgctcggtgtatgctccatcatgggcctgccatggtttgtggctgccacagtcctctccatcactcatgtcaatagcctaaaactggaatcagaatgctcagctccaggagaacaacccaaatttctcggcattcgggagcaaagggttactgggcttatgatttttattcttatgggttcatcagtctttatgaccagtattctgaagtttattcccatgccagtgctatatggagtgtttctttatatgggtgcttcatctctaaagggaattcagttctttgataggataaagctcttctggatgccggcaaaacatcaaccagattttatatacctaaggcacgtaccgcttcgaaaagtgcatctcttcacaattattcagatgagttgccttggccttttgtggataataaaagtttcaagagctgctattgtctttcccatgatggtgttagccctggtatttgtaagaaagttgatggacttgttgttcacgaagcgggaactcagctggttggatgatttgatgcccgagagtaagaaaaagaaactggaagatgctgaaaaagaagaagaacaaagtatgctagctatggaagatgagggcacagtacaactcccattggaagggcactatagagatgatccatctgtgatcaatatatctgatgaaatgtcaaagactgccttgtggaggaaccttctgattactgccgataactcaaaagataaggagtcaagctttccttccaaaagcattgaaagccgaaaagagaagaaagctgactcagggaaaggtgttgacagggagacttgtctatga

SEQ ID NO: 29187 - DNA, 5710 bp, Homo sapiens
gtgcaaaacctggccagcagcccgagtgagtaggagccatgtgactctggtgagttggagtgtgcaattgcctcctgcttcagagctacctgatccgaatactaagcagagcgagtgccgggctgagtgtaagacactgaagacactgcagagcaaggtgcttattccagaggcgttacaaaacatggagattaaagaccagggagcccaaatggagccgctgctgcctacgccctgaagatgctgagacatagagatggctgtgattatcttttgtaagacaggaaatgcagtctttaggggtttctggaaatagaaaggtcatgcagtctggaacctgtgagccttttcaatctctaagtcatcagagaaatgatgaagaagcagttgtggatagaggtggaactcgttctattctcaaaacacactttgagaaagaagatttagaaggtcatcgaacactatttattggagtacatgtgcccttgggaggaagaaaaagccatcgacgtcacaggcatcgtggtcataaacacagaaagagagacagagaaagagattcaggattagaggatggaagggagtcaccttcttttgacaccccatcacagagggtacagtttattcttggaaccgaggatgatgacgaggaacacattcctcatgaccttttcacagaactggatgagatttgttggcgtgaaggtgaggacgctgagtggcgagaaacagccaggtggttgaagtttgaagaagatgtggaagatggaggagaaaggtggagcaagccttatgtggctactctttcattgcacagcttgtttgaattgagaagttgtattctgaatggaactgtgttgctggacatgcatgccaacactttagaagaaattgcagatatggttcttgaccaacaagtgagctcaggtcagctgaatgaagatgtacgccatagggtccatgaggcattgatgaaacagcatcatcatcagaatcagaaaaaactcaccaacaggattcccattgttcgttcctttgctgatattggcaagaaacagtcagaaccaaattccatggacaaaaatgcaggtcaggttgtttctcctcagtctgctccagcctgtgttgaaaataaaaatgatgttagcagagaaaacagcactgttgactttagcaaggttgatctgcattttatgaaaaagattcctccaggtgctgaagcatcgaacatcttagtgggagaactggagttcttggatcgaacagtagttgcgtttgtcaggttgtctccagctgtattgcttcaaggactggctgaagtcccaatcccaaccagatttttgttcattcttctgggacccctgggaaagggtcaacagtaccatgagattggcagatcaattgcaaccctaatgacagatgaggtatttcatgatgttgcctataaagctaaagatcgtaatgacttggtatcaggaattgatgagtttctggatcaggttactgttctccctcctggagaatgggatccaagcattcgaatagagcctcccaaaaatgttccttcccaggagaagaggaagattcctgctgtaccaaatggaacagcagctcatggggaagcagagccccacggaggacatagtggacctgaactccagcgaactggaaggatttttgggggacttattttagatatcaaaagaaaagctccatacttctggagtgacttcagagatgctttcagcctgcagtgcttagcatcttttctatttctctactgcgcgtgtatgtctcctgtcatcacgtttggaggactgctgggagaagcaactgaagggcgtataagtgcaattgaatctctctttggagcatccatgaccgggatagcctattctctctttggtggacagcctcttaccatattaggcagtacaggaccagttttggtgtttgaaaagattttgtttaaattttgcaaagaatatgggctgtcatacctatctttaagagctagcattggactttggactgcaactctatgtatcatacttgtggccacagatgctagttcccttgtctgctacatcactcggtttactgaagaagcttttgcttccctgatttgcatcattttcatttatgaggccctggagaagttgtttgaactcagtgaagcatatccaatcaacatgcataatgatctggaactgctgacacaatactcgtgtaactgtgtggaaccgcataatcccagcaatggcacattgaaggaatggagggaatccaatatttctgcctctgacataatttgggagaacctaactgtgtcagaatgcaaatcattgcatggagagtatgttggacgggcctgtggccatgatcacccatatgttccagatgttctattttggtctgtgatcctgttcttttccacagttactctgtcagccaccctgaagcagttcaagactagcagatattttccaaccaaggttcgatccatagtgagtgactttgctgtctttcttacaattctgtgtatggttttaattgactatgccattgggatcccatctccaaaactacaagtaccaagtgttttcaagcccactagagatgatcgtggctggtttgttacgcctttaggtccaaacccatggtggacagtaatagctgctataattccagctctgctttgtactattctaatttttatggaccaacagattacagctgtcatcatcaacaggaaagagcataagctaaagaaaggttgtgggtaccatctggacctattaatggtggctgtcatgctcggtgtatgctccatcatgggcctgccatggtttgtggctgccacagtcctctccatcactcatgtcaatagcctaaaactggaatcagaatgctcagctccaggagaacaacccaaatttctcggcattcgggagcaaagggttactgggcttatgatttttattcttatgggttcatcagtctttatgaccagtattctgaagtttattcccatgccagtgctatatggagtgtttctttatatgggtgcttcatctctaaagggaattcagttctttgataggataaagctcttctggatgccggcaaaacatcaaccagattttatatacctaaggcacgtaccgcttcgaaaagtgcatctcttcacaattattcagatgagttgccttggccttttgtggataataaaagtttcaagagctgctattgtctttcccatgatggtgttagccctggtatttgtaagaaagttgatggacttgttgttcacgaagcgggaactcagctggttggatgatttgatgcccgagagtaagaaaaagaaactggaagatgctgaaaaagaagaagaacaaagtatgctagctatggaagatgagggcacagtacaactcccattggaagggcactatagagatgatccatctgtgatcaatatatctgatgaaatgtcaaagactgccttgtggaggaaccttctgattactgccgataactcaaaagataaggagtcaagctttccttccaaaagctccccttcctaatcactctagaagctgattccccaaagcattgaaagccgaaaagagaagaaagctgactcagggaaaggtgttgacagggagacttgtctatgactcgatcttcaatttattttttacatatatatgagaagagtgtcacaattattaataaaactgctttgatcatgtattgtaaattctgtccctcaacccaaatccaccttcatactgtaagtagtgcaatacttgtttcatttctgtgtttaaacttctgagcagtgagacatccctgtgagcagatacaatagccaatgcaagaatctgtgtgttccttgctgtacgttagacatttgtaaactggattctgattgtcagttttatgagagcaatagcttccttaaagagataagtcatatttacctagtttgtattttcctactttagtgacctgaagatgcctgataatttcattcagaagaatttttgaaaggtagtcttacttctttttagtttttatagcttagcattagtgacttatttcaaaagacccaaatcaaaaagttagtttgaaagcattttttaataattgtatttatgcatttccttgatttaatatgataaatttaatacttaacaatttatatgtaactaaaacttaaagtcatttgaaaaatatatagaaacctatttacaacttgttaaggacaatcagacataatgcagagttaagtagtatttgcttaaaattcaagttgtgactaatgatcaaatactaggcttgtacgaaatgctttagaaaaactttgtaacagttttgtgggatttttcaatataaacctttatcagaaatatactaagtttgtctcccactgacaacagatgttttccaaataaacatattctatacatacttgtggaatgccacatggtgaatcattgtatatgaaattccactcctgtacagttactctgcagctaatggtcatgcactgcttaatgctggtcctgaatcatgttctcatgttagaccaacagctctccaattgtcattttttttctgcagagttttttttttccacttttaaattaaatgcatgttgtggaaaaacagtcttttaaaatgaaatttcagattccatttgagaaggttctgtagatatttcagtccatataaaataatacatctttactaaacttatataaggggagagaaagttatgaagttttggacattactaaaagtacagtatttgatttcactttcaatgaatgtgaagttaataaaactaaatctcataatgctcttggttcctaagaatgagtagtaatcatcaactttataatactccaatattccgttttataataattcagagccctgtggcttttacacaccgttaattatgtactctgttggaagtgcacatgaaaagtgaagaaaagttcctcttgtgattaaactaatgggaggaaataaatcaacaaagtctccattaagttctacattttgagaccttttaaaaattcccctcacaattctttaaggagcccccctttttatggaacatgagcctaaaaattatagaaagaagaattttaagttaataaagtttgtatttataaatgctgaaaaaatacagaaactttctgttccaaatgtgttgcctttgtgtattttataatacagatactacattgtaaacatttccattgttttatgatttagccagtgattccccaaagcagcctcttagtgttttaatatattaataactgttttgttaaaaatgatcatagtgaatttaaatcttcacatgatcacctatttgaataagcaatcatatccaatgaaattctgtatttctgagtatttttatagtcattttgttcttgtgtgaattttaaagctatccctatgttaatcctaatattttgaaatcatataaaatataataaaaatgtagtattatatatttacttctaatttcagattcctggtcaaaattactaaatatcttgaatgtaatttagtgccaagtttaaataatgtgtaaatgtgactaggatattgtgtttttcacaattaagaaatgttatgtggaaataaatatttatcctaacttccttgcacattttaaattgtg

SEQ ID NO: 29188 - DNA, 3354 bp, Homo sapiens
atggagattaaagaccagggagcccaaatggagccgctgctgcctacgagaaatgatgaagaagcagttgtggatagaggtggaactcgttctattctcaaaacacactttgagaaagaagatttagaaggtcatcgaacactatttattggagtacatgtgcccttgggaggaagaaaaagccatcgacgtcacaggcatcgtggtcataaacacagaaagagagacagagaaagagattcaggattagaggatggaagggagtcaccttcttttgacaccccatcacagagggtacagtttattcttggaaccgaggatgatgacgaggaacacattcctcatgaccttttcacagaactggatgagatttgttggcgtgaaggtgaggacgctgagtggcgagaaacagccaggtggttgaagtttgaagaagatgtggaagatggaggagaaaggtggagcaagccttatgtggctactctttcattgcacagcttgtttgaattgagaagttgtattctgaatggaactgtgttgctggacatgcatgccaacactttagaagaaattgcagatatggttcttgaccaacaagtgagctcaggtcagctgaatgaagatgtacgccatagggtccatgaggcattgatgaaacagcatcatcatcagaatcagaaaaaactcaccaacaggattcccattgttcgttcctttgctgatattggcaagaaacagtcagaaccaaattccatggacaaaaatggtcaggttgtttctcctcagtctgctccagcctgtgttgaaaataaaaatgatgttagcagagaaaacagcactgttgactttagcaagggactgggaggccaacaaaaggggcatactagtccatgtgggatgaaacaaaggcatgaaaaaggacctccacaccagcaagagagagaggttgatctgcattttatgaaaaagattcctccaggtgctgaagcatcgaacatcttagtgggagaactggagttcttggatcgaacagtagttgcgtttgtcaggttgtctccagctgtattgcttcaaggactggctgaagtcccaatcccaaccagatttttgttcattcttctgggacccctgggaaagggtcaacagtaccatgagattggcagatcaattgcaaccctaatgacagatgaggtatttcatgatgttgcctataaagctaaagatcgtaatgacttggtatcaggaattgatgagtttctggatcaggttactgttctccctcctggagaatgggatccaagcattcgaatagagcctcccaaaaatgttccttcccaggagaagaggaagattcctgctgtaccaaatggaacagcagctcatggggaagcagagccccacggaggacatagtggacctgaactccagcgaactggaaggatttttgggggacttattttagatatcaaaagaaaagctccatacttctggagtgacttcagagatgctttcagcctgcagtgcttagcatcttttctatttctctactgcgcgtgtatgtctcctgtcatcacgtttggaggactgctgggagaagcaactgaagggcgtataagtgcaattgaatctctctttggagcatccatgaccgggatagcctattctctctttggtggacagcctcttaccatattaggcagtacaggaccagttttggtgtttgaaaagattttgtttaaattttgcaaagaatatgggctgtcatacctatctttaagagctagcattggactttggactgcaactctatgtatcatacttgtggccacagatgctagttcccttgtctgctacatcactcggtttactgaagaagcttttgcttccctgatttgcatcattttcatttatgaggccctggagaagttgtttgaactcagtgaagcatatccaatcaacatgcataatgatctggaactgctgacacaatactcgtgtaactgtgtggaaccgcataatcccagcaatggcacattgaaggaatggagggaatccaatatttctgcctctgacataatttgggagaacctaactgtgtcagaatgcaaatcattgcatggagagtatgttggacgggcctgtggccatgatcacccatatgttccagatgttctattttggtctgtgatcctgttcttttccacagttactctgtcagccaccctgaagcagttcaagactagcagatattttccaaccaaggttcgatccatagtgagtgactttgctgtctttcttacaattctgtgtatggttttaattgactatgccattgggatcccatctccaaaactacaagtaccaagtgttttcaagcccactagagatgatcgtggctggtttgttacgcctttaggtccaaacccatggtggacagtaatagctgctataattccagctctgctttgtactattctaatttttatggaccaacagattacagctgtcatcatcaacaggaaagagcataagctaaagaaaggttgtgggtaccatctggacctattaatggtggctgtcatgctcggtgtatgctccatcatgggcctgccatggtttgtggctgccacagtcctctccatcactcatgtcaatagcctaaaactggaatcagaatgctcagctccaggagaacaacccaaatttctcggcattcgggagcaaagggttactgggcttatgatttttattcttatgggttcatcagtctttatgaccagtattctgaagtttattcccatgccagtgctatatggagtgtttctttatatgggtgcttcatctctaaagggaattcagttctttgataggataaagctcttctggatgccggcaaaacatcaaccagattttatatacctaaggcacgtaccgcttcgaaaagtgcatctcttcacaattattcagatgagttgccttggccttttgtggataataaaagtttcaagagctgctattgtctttcccatgatggtgttagccctggtatttgtaagaaagttgatggacttgttgttcacgaagcgggaactcagctggttggatgatttgatgcccgagagtaagaaaaagaaactggaagatgctgaaaaagaagaagaacaaagtatgctagctatggaagatgagggcacagtacaactcccattggaagggcactatagagatgatccatctgtgatcaatatatctgatgaaatgtcaaagactgccttgtggaggaaccttctgattactgccgataactcaaaagataaggagtcaagctttccttccaaaagctccccttcctaa

SEQ ID NO: 29189 - DNA, 5578 bp, Homo sapiens
caaaacctggccagcagcccgagtgagtaggagccatgtgactctggtgagttggagtgtgcaattgcctcctgcttcagagctacctgatccgaatactaagcagagcgagtgccgggctgagtgtaagacactgaagacactgcagagcaaggtgcttattccagaggcgttacaaaacatggagattaaagaccagggagcccaaatggagccgctgctgcctacgagaaatgatgaagaagcagttgtggatagaggtggaactcgttctattctcaaaacacactttgagaaagaagatttagaaggtcatcgaacactatttattggagtacatgtgcccttgggaggaagaaaaagccatcgacgtcacaggcatcgtggtcataaacacagaaagagagacagagaaagagattcaggattagaggatggaagggagtcaccttcttttgacaccccatcacagagggtacagtttattcttggaaccgaggatgatgacgaggaacacattcctcatgaccttttcacagaactggatgagatttgttggcgtgaaggtgaggacgctgagtggcgagaaacagccaggtggttgaagtttgaagaagatgtggaagatggaggagaaaggtggagcaagccttatgtggctactctttcattgcacagcttgtttgaattgagaagttgtattctgaatggaactgtgttgctggacatgcatgccaacactttagaagaaattgcagatatggttcttgaccaacaagtgagctcaggtcagctgaatgaagatgtacgccatagggtccatgaggcattgatgaaacagcatcatcatcagaatcagaaaaaactcaccaacaggattcccattgttcgttcctttgctgatattggcaagaaacagtcagaaccaaattccatggacaaaaatgcaggtcaggttgtttctcctcagtctgctccagcctgtgttgaaaataaaaatgatgttagcagagaaaacagcactgttgactttagcaaggttgatctgcattttatgaaaaagattcctccaggtgctgaagcatcgaacatcttagtgggagaactggagttcttggatcgaacagtagttgcgtttgtcaggttgtctccagctgtattgcttcaaggactggctgaagtcccaatcccaaccagatttttgttcattcttctgggacccctgggaaagggtcaacagtaccatgagattggcagatcaattgcaaccctaatgacagatgaggtatttcatgatgttgcctataaagctaaagatcgtaatgacttggtatcaggaattgatgagtttctggatcaggttactgttctccctcctggagaatgggatccaagcattcgaatagagcctcccaaaaatgttccttcccaggagaagaggaagattcctgctgtaccaaatggaacagcagctcatggggaagcagagccccacggaggacatagtggacctgaactccagcgaactggaaggatttttgggggacttattttagatatcaaaagaaaagctccatacttctggagtgacttcagagatgctttcagcctgcagtgcttagcatcttttctatttctctactgcgcgtgtatgtctcctgtcatcacgtttggaggactgctgggagaagcaactgaagggcgtataagtgcaattgaatctctctttggagcatccatgaccgggatagcctattctctctttggtggacagcctcttaccatattaggcagtacaggaccagttttggtgtttgaaaagattttgtttaaattttgcaaagaatatgggctgtcatacctatctttaagagctagcattggactttggactgcaactctatgtatcatacttgtggccacagatgctagttcccttgtctgctacatcactcggtttactgaagaagcttttgcttccctgatttgcatcattttcatttatgaggccctggagaagttgtttgaactcagtgaagcatatccaatcaacatgcataatgatctggaactgctgacacaatactcgtgtaactgtgtggaaccgcataatcccagcaatggcacattgaaggaatggagggaatccaatatttctgcctctgacataatttgggagaacctaactgtgtcagaatgcaaatcattgcatggagagtatgttggacgggcctgtggccatgatcacccatatgttccagatgttctattttggtctgtgatcctgttcttttccacagttactctgtcagccaccctgaagcagttcaagactagcagatattttccaaccaaggttcgatccatagtgagtgactttgctgtctttcttacaattctgtgtatggttttaattgactatgccattgggatcccatctccaaaactacaagtaccaagtgttttcaagcccactagagatgatcgtggctggtttgttacgcctttaggtccaaacccatggtggacagtaatagctgctataattccagctctgctttgtactattctaatttttatggaccaacagattacagctgtcatcatcaacaggaaagagcataagctaaagaaaggttgtgggtaccatctggacctattaatggtggctgtcatgctcggtgtatgctccatcatgggcctgccatggtttgtggctgccacagtcctctccatcactcatgtcaatagcctaaaactggaatcagaatgctcagctccaggagaacaacccaaatttctcggcattcgggagcaaagggttactgggcttatgatttttattcttatgggttcatcagtctttatgaccagtattctgaagtttattcccatgccagtgctatatggagtgtttctttatatgggtgcttcatctctaaagggaattcagttctttgataggataaagctcttctggatgccggcaaaacatcaaccagattttatatacctaaggcacgtaccgcttcgaaaagtgcatctcttcacaattattcagatgagttgccttggccttttgtggataataaaagtttcaagagctgctattgtctttcccatgatggtgttagccctggtatttgtaagaaagttgatggacttgttgttcacgaagcgggaactcagctggttggatgatttgatgcccgagagtaagaaaaagaaactggaagatgctgaaaaagaagaagaacaaagtatgctagctatggaagatgagggcacagtacaactcccattggaagggcactatagagatgatccatctgtgatcaatatatctgatgaaatgtcaaagactgccttgtggaggaaccttctgattactgccgataactcaaaagataaggagtcaagctttccttccaaaagctccccttcctaatcactctagaagctgattccccaaagcattgaaagccgaaaagagaagaaagctgactcagggaaaggtgttgacagggagacttgtctatgactcgatcttcaatttattttttacatatatatgagaagagtgtcacaattattaataaaactgctttgatcatgtattgtaaattctgtccctcaacccaaatccaccttcatactgtaagtagtgcaatacttgtttcatttctgtgtttaaacttctgagcagtgagacatccctgtgagcagatacaatagccaatgcaagaatctgtgtgttccttgctgtacgttagacatttgtaaactggattctgattgtcagttttatgagagcaatagcttccttaaagagataagtcatatttacctagtttgtattttcctactttagtgacctgaagatgcctgataatttcattcagaagaatttttgaaaggtagtcttacttctttttagtttttatagcttagcattagtgacttatttcaaaagacccaaatcaaaaagttagtttgaaagcattttttaataattgtatttatgcatttccttgatttaatatgataaatttaatacttaacaatttatatgtaactaaaacttaaagtcatttgaaaaatatatagaaacctatttacaacttgttaaggacaatcagacataatgcagagttaagtagtatttgcttaaaattcaagttgtgactaatgatcaaatactaggcttgtacgaaatgctttagaaaaactttgtaacagttttgtgggatttttcaatataaacctttatcagaaatatactaagtttgtctcccactgacaacagatgttttccaaataaacatattctatacatacttgtggaatgccacatggtgaatcattgtatatgaaattccactcctgtacagttactctgcagctaatggtcatgcactgcttaatgctggtcctgaatcatgttctcatgttagaccaacagctctccaattgtcattttttttctgcagagttttttttttccacttttaaattaaatgcatgttgtggaaaaacagtcttttaaaatgaaatttcagattccatttgagaaggttctgtagatatttcagtccatataaaataatacatctttactaaacttatataaggggagagaaagttatgaagttttggacattactaaaagtacagtatttgatttcactttcaatgaatgtgaagttaataaaactaaatctcataatgctcttggttcctaagaatgagtagtaatcatcaactttataatactccaatattccgttttataataattcagagccctgtggcttttacacaccgttaattatgtactctgttggaagtgcacatgaaaagtgaagaaaagttcctcttgtgattaaactaatgggaggaaataaatcaacaaagtctccattaagttctacattttgagaccttttaaaaattcccctcacaattctttaaggagcccccctttttatggaacatgagcctaaaaattatagaaagaagaattttaagttaataaagtttgtatttataaatgctgaaaaaatacagaaactttctgttccaaatgtgttgcctttgtgtattttataatacagatactacattgtaaacatttccattgttttatgatttagccagtgattccccaaagcagcctcttagtgttttaatatattaataactgttttgttaaaaatgatcatagtgaatttaaatcttcacatgatcacctatttgaataagcaatcatatccaatgaaattctgtatttctgagtatttttatagtcattttgttcttgtgtgaattttaaagctatccctatgttaatcctaatattttgaaatcatataaaatataataaaaatgtagtattatatatttacttctaatttcagattcctggtcaaaattactaaatatcttgaatgtaatttagtgccaagtttaaataatgtgtaaatgtgactaggatattgtgtttttcacaattaagaaatgttatgtggaaataaatatttatcctaacttccttgcacattttaaattgtgatacaaa

SEQ ID NO: 29190 - DNA, 3398 bp, Homo sapiens
gtgtaagacactgaagacactgcagagcaaggtgcttattccagaggcgttacaaaacatggagattaaagaccagggagcccaaatggagccgctgctgcctacgagaaatgatgaagaagcagttgtggatagaggtggaactcgttctattctcaaaacacactttgagaaagaagatttagaaggtcatcgaacactatttattggagtacatgtgcccttgggaggaagaaaaagccatcgacgtcacaggcatcgtggtcataaacacagaaagagagacagagaaagagattcaggattagaggatggaagggagtcaccttcttttgacaccccatcacagagggtacagtttattcttggaaccgaggatgatgacgaggaacacattcctcatgaccttttcacagaactggatgagatttgttggcgtgaaggtgaggacgctgagtggcgagaaacagccaggtggttgaagtttgaagaagatgtggaagatggaggagaaaggtggagcaagccttatgtggctactctttcattgcacagcttgtttgaattgagaagttgtattctgaatggaactgtgttgctggacatgcatgccaacactttagaagaaattgcagatatggttcttgaccaacaagtgagctcaggtcagctgaatgaagatgtacgccatagggtccatgaggcattgatgaaacagcatcatcatcagaatcagaaaaaactcaccaacaggattcccattgttcgttcctttgctgatattggcaagaaacagtcagaaccaaattccatggacaaaaatgcaggtcaggttgtttctcctcagtctgctccagcctgtgttgaaaataaaaatgatgttagcagagaaaacagcactgttgactttagcaagggactgggaggccaacaaaaggggcatactagtccatgtgggatgaaacaaaggcatgaaaaaggacctccacaccagcaagagagagaggttgatctgcattttatgaaaaagattcctccaggtgctgaagcatcgaacatcttagtgggagaactggagttcttggatcgaacagtagttgcgtttgtcaggttgtctccagctgtattgcttcaaggactggctgaagtcccaatcccaaccagatttttgttcattcttctgggacccctgggaaagggtcaacagtaccatgagattggcagatcaattgcaaccctaatgacagatgaggtatttcatgatgttgcctataaagctaaagatcgtaatgacttggtatcaggaattgatgagtttctggatcaggttactgttctccctcctggagaatgggatccaagcattcgaatagagcctcccaaaaatgttccttcccaggagaagaggaagattcctgctgtaccaaatggaacagcagctcatggggaagcagagccccacggaggacatagtggacctgaactccagcgaactggaaggatttttgggggacttattttagatatcaaaagaaaagctccatacttctggagtgacttcagagatgctttcagcctgcagtgcttagcatcttttctatttctctactgcgcgtgtatgtctcctgtcatcacgtttggaggactgctgggagaagcaactgaagggcgtataagtgcaattgaatctctctttggagcatccatgaccgggatagcctattctctctttggtggacagcctcttaccatattaggcagtacaggaccagttttggtgtttgaaaagattttgtttaaattttgcaaagaatatgggctgtcatacctatctttaagagctagcattggactttggactgcaactctatgtatcatacttgtggccacagatgctagttcccttgtctgctacatcactcggtttactgaagaagcttttgcttccctgatttgcatcattttcatttatgaggccctggagaagttgtttgaactcagtgaagcatatccaatcaacatgcataatgatctggaactgctgacacaatactcgtgtaactgtgtggaaccgcataatcccagcaatggcacattgaaggaatggagggaatccaatatttctgcctctgacataatttgggagaacctaactgtgtcagaatgcaaatcattgcatggagagtatgttggacgggcctgtggccatgatcacccatatgttccagatgttctattttggtctgtgatcctgttcttttccacagttactctgtcagccaccctgaagcagttcaagactagcagatattttccaaccaaggttcgatccatagtgagtgactttgctgtctttcttacaattctgtgtatggttttaattgactatgccattgggatcccatctccaaaactacaagtaccaagtgttttcaagcccactagagatgatcgtggctggtttgttacgcctttaggtccaaacccatggtggacagtaatagctgctataattccagctctgctttgtactattctaatttttatggaccaacagattacagctgtcatcatcaacaggaaagagcataagctaaagaaaggttgtgggtaccatctggacctattaatggtggctgtcatgctcggtgtatgctccatcatgggcctgccatggtttgtggctgccacagtcctctccatcactcatgtcaatagcctaaaactggaatcagaatgctcagctccaggagaacaacccaaatttctcggcattcgggagcaaagggttactgggcttatgatttttattcttatgggttcatcagtctttatgaccagtattctgaagtttattcccatgccagtgctatatggagtgtttctttatatgggtgcttcatctctaaagggaattcagttctttgataggataaagctcttctggatgccggcaaaacatcaaccagattttatatacctaaggcacgtaccgcttcgaaaagtgcatctcttcacaattattcagatgagttgccttggccttttgtggataataaaagtttcaagagctgctattgtctttcccatgatggtgttagccctggtatttgtaagaaagttgatggacttgttgttcacgaagcgggaactcagctggttggatgatttgatgcccgagagtaagaaaaagaaactggaagatgctgaaaaagaacattgaaagccgaaaagagaagaaagctgactcagggaaaggtgttgacagggagacttgtctatgactcgatcttcaatttattttttacatatatatgagaagagtgtcacaattattaataaaactgctttgatcatgtattgtaaattctgtccctcaacccaaatccaccttcata

SEQ ID NO: 29191 - DNA, 5551 bp, Homo sapiens
gatccgaatactaagcagagcgagtgccgggctgagtgtaagacactgaagacactgcagagcaaggtgcttattccagaggcgttacaaaacatggagattaaagaccagggagcccaaatggagccgctgctgcctacgagaaatgatgaagaagcagttgtggatagaggtggaactcgttctattctcaaaacacactttgagaaagaagatttagaaggtcatcgaacactatttattggagtacatgtgcccttgggaggaagaaaaagccatcgacgtcacaggcatcgtggtcataaacacagaaagagagacagagaaagagattcaggattagaggatggaagggagtcaccttcttttgacaccccatcacagagggtacagtttattcttggaaccgaggatgatgacgaggaacacattcctcatgaccttttcacagaactggatgagatttgttggcgtgaaggtgaggacgctgagtggcgagaaacagccaggtggttgaagtttgaagaagatgtggaagatggaggagaaaggtggagcaagccttatgtggctactctttcattgcacagcttgtttgaattgagaagttgtattctgaatggaactgtgttgctggacatgcatgccaacactttagaagaaattgcagatatggttcttgaccaacaagtgagctcaggtcagctgaatgaagatgtacgccatagggtccatgaggcattgatgaaacagcatcatcatcagaatcagaaaaaactcaccaacaggattcccattgttcgttcctttgctgatattggcaagaaacagtcagaaccaaattccatggacaaaaatgcaggtcaggttgtttctcctcagtctgctccagcctgtgttgaaaataaaaatgatgttagcagagaaaacagcactgttgactttagcaagggactgggaggccaacaaaaggggcatactagtccatgtgggatgaaacaaaggcatgaaaaaggacctccacaccagcaagagagagaggttgatctgcattttatgaaaaagattcctccaggtgctgaagcatcgaacatcttagtgggagaactggagttcttggatcgaacagtagttgcgtttgtcaggttgtctccagctgtattgcttcaaggactggctgaagtcccaatcccaaccagatttttgttcattcttctgggacccctgggaaagggtcaacagtaccatgagattggcagatcaattgcaaccctaatgacagatgaggtatttcatgatgttgcctataaagctaaagatcgtaatgacttggtatcaggaattgatgagtttctggatcaggttactgttctccctcctggagaatgggatccaagcattcgaatagagcctcccaaaaatgttccttcccaggagaagaggaagattcctgctgtaccaaatggaacagcagctcatggggaagcagagccccacggaggacatagtggacctgaactccagcgaactggaaggatttttgggggacttattttagatatcaaaagaaaagctccatacttctggagtgacttcagagatgctttcagcctgcagtgcttagcatcttttctatttctctactgcgcgtgtatgtctcctgtcatcacgtttggaggactgctgggagaagcaactgaagggcgtataagtgcaattgaatctctctttggagcatccatgaccgggatagcctattctctctttggtggacagcctcttaccatattaggcagtacaggaccagttttggtgtttgaaaagattttgtttaaattttgcaaagaatatgggctgtcatacctatctttaagagctagcattggactttggactgcaactctatgtatcatacttgtggccacagatgctagttcccttgtctgctacatcactcggtttactgaagaagcttttgcttccctgatttgcatcattttcatttatgaggccctggagaagttgtttgaactcagtgaagcatatccaatcaacatgcataatgatctggaactgctgacacaatactcgtgtaactgtgtggaaccgcataatcccagcaatggcacattgaaggaatggagggaatccaatatttctgcctctgacataatttgggagaacctaactgtgtcagaatgcaaatcattgcatggagagtatgttggacgggcctgtggccatgatcacccatatgttccagatgttctattttggtctgtgatcctgttcttttccacagttactctgtcagccaccctgaagcagttcaagactagcagatattttccaaccaaggttcgatccatagtgagtgactttgctgtctttcttacaattctgtgtatggttttaattgactatgccattgggatcccatctccaaaactacaagtaccaagtgttttcaagcccactagagatgatcgtggctggtttgttacgcctttaggtccaaacccatggtggacagtaatagctgctataattccagctctgctttgtactattctaatttttatggaccaacagattacagctgtcatcatcaacaggaaagagcataagctaaagaaaggttgtgggtaccatctggacctattaatggtggctgtcatgctcggtgtatgctccatcatgggcctgccatggtttgtggctgccacagtcctctccatcactcatgtcaatagcctaaaactggaatcagaatgctcagctccaggagaacaacccaaatttctcggcattcgggagcaaagggttactgggcttatgatttttattcttatgggttcatcagtctttatgaccagtattctgaagtttattcccatgccagtgctatatggagtgtttctttatatgggtgcttcatctctaaagggaattcagttctttgataggataaagctcttctggatgccggcaaaacatcaaccagattttatatacctaaggcacgtaccgcttcgaaaagtgcatctcttcacaattattcagatgagttgccttggccttttgtggataataaaagtttcaagagctgctattgtctttcccatgatggtgttagccctggtatttgtaagaaagttgatggacttgttgttcacgaagcgggaactcagctggttggatgatttgatgcccgagagtaagaaaaagaaactggaagatgctgaaaaagaagaagaacaaagtatgctagctatggaagatgagggcacagtacaactcccattggaagggcactatagagatgatccatctgtgatcaatatatctgatgaaatgtcaaagactgccttgtggaggaaccttctgattactgccgataactcaaaagataaggagtcaagctttccttccaaaagctccccttcctaatcactctagaagctgattccccaaagcattgaaagccgaaaagagaagaaagctgactcagggaaaggtgttgacagggagacttgtctatgactcgatcttcaatttattttttacatatatatgagaagagtgtcacaattattaataaaactgctttgatcatgtattgtaaattctgtccctcaacccaaatccaccttcatactgtaagtagtgcaatacttgtttcatttctgtgtttaaacttctgagcagtgagacatccctgtgagcagatacaatagccaatgcaagaatctgtgtgttccttgctgtacgttagacatttgtaaactggattctgattgtcagttttatgagagcaatagcttccttaaagagataagtcatatttacctagtttgtattttcctactttagtgacctgaagatgcctgataatttcattcagaagaatttttgaaaggtagtcttacttctttttagtttttatagcttagcattagtgacttatttcaaaagacccaaatcaaaaagttagtttgaaagcattttttaataattgtatttatgcatttccttgatttaatatgataaatttaatacttaacaatttatatgtaactaaaacttaaagtcatttgaaaaatatatagaaacctatttacaacttgttaaggacaatcagacataatgcagagttaagtagtatttgcttaaaattcaagttgtgactaatgatcaaatactaggcttgtacgaaatgctttagaaaaactttgtaacagttttgtgggatttttcaatataaacctttatcagaaatatactaagtttgtctcccactgacaacagatgttttccaaataaacatattctatacatacttgtggaatgccacatggtgaatcattgtatatgaaattccactcctgtacagttactctgcagctaatggtcatgcactgcttaatgctggtcctgaatcatgttctcatgttagaccaacagctctccaattgtcattttttttctgcagagttttttttttccacttttaaattaaatgcatgttgtggaaaaacagtcttttaaaatgaaatttcagattccatttgagaaggttctgtagatatttcagtccatataaaataatacatctttactaaacttatataaggggagagaaagttatgaagttttggacattactaaaagtacagtatttgatttcactttcaatgaatgtgaagttaataaaactaaatctcataatgctcttggttcctaagaatgagtagtaatcatcaactttataatactccaatattccgttttataataattcagagccctgtggcttttacacaccgttaattatgtactctgttggaagtgcacatgaaaagtgaagaaaagttcctcttgtgattaaactaatgggaggaaataaatcaacaaagtctccattaagttctacattttgagaccttttaaaaattcccctcacaattctttaaggagcccccctttttatggaacatgagcctaaaaattatagaaagaagaattttaagttaataaagtttgtatttataaatgctgaaaaaatacagaaactttctgttccaaatgtgttgcctttgtgtattttataatacagatactacattgtaaacatttccattgttttatgatttagccagtgattccccaaagcagcctcttagtgttttaatatattaataactgttttgttaaaaatgatcatagtgaatttaaatcttcacatgatcacctatttgaataagcaatcatatccaatgaaattctgtatttctgagtatttttatagtcattttgttcttgtgtgaattttaaagctatccctatgttaatcctaatattttgaaatcatataaaatataataaaaatgtagtattatatatttacttctaatttcagattcctggtcaaaattactaaatatcttgaatgtaatttagtgccaagtttaaataatgtgtaaatgtgactaggatattgtgtttttcacaattaagaaatgttatgtggaaataaatatttatcctaact

SEQ ID NO: 29192 - DNA, 3411 bp, Homo sapiens
gatccgaatactaagcagagcgagtgccgggctgagtgtaagacactgaagacactgcagagcaaggtgcttattccagaggcgttacaaaacatggagattaaagaccagggagcccaaatggagccgctgctgcctacgagaaatgatgaagaagcagttgtggatagaggtggaactcgttctattctcaaaacacactttgagaaagaagatttagaaggtcatcgaacactatttattggagtacatgtgcccttgggaggaagaaaaagccatcgacgtcacaggcatcgtggtcataaacacagaaagagagacagagaaagagattcaggattagaggatggaagggagtcaccttcttttgacaccccatcacagagggtacagtttattcttggaaccgaggatgatgacgaggaacacattcctcatgaccttttcacagaactggatgagatttgttggcgtgaaggtgaggacgctgagtggcgagaaacagccaggtggttgaagtttgaagaagatgtggaagatggaggagaaaggtggagcaagccttatgtggctactctttcattgcacagcttgtttgaattgagaagttgtattctgaatggaactgtgttgctggacatgcatgccaacactttagaagaaattgcagatatggttcttgaccaacaagtgagctcaggtcagctgaatgaagatgtacgccatagggtccatgaggcattgatgaaacagcatcatcatcagaatcagaaaaaactcaccaacaggattcccattgttcgttcctttgctgatattggcaagaaacagtcagaaccaaattccatggacaaaaatggtcaggttgtttctcctcagtctgctccagcctgtgttgaaaataaaaatgatgttagcagagaaaacagcactgttgactttagcaaggttgatctgcattttatgaaaaagattcctccaggtgctgaagcatcgaacatcttagtgggagaactggagttcttggatcgaacagtagttgcgtttgtcaggttgtctccagctgtattgcttcaaggactggctgaagtcccaatcccaaccagatttttgttcattcttctgggacccctgggaaagggtcaacagtaccatgagattggcagatcaattgcaaccctaatgacagatgaggtatttcatgatgttgcctataaagctaaagatcgtaatgacttggtatcaggaattgatgagtttctggatcaggttactgttctccctcctggagaatgggatccaagcattcgaatagagcctcccaaaaatgttccttcccaggagaagaggaagattcctgctgtaccaaatggaacagcagctcatggggaagcagagccccacggaggacatagtggacctgaactccagcgaactggaaggatttttgggggacttattttagatatcaaaagaaaagctccatacttctggagtgacttcagagatgctttcagcctgcagtgcttagcatcttttctatttctctactgcgcgtgtatgtctcctgtcatcacgtttggaggactgctgggagaagcaactgaagggcgtataagtgcaattgaatctctctttggagcatccatgaccgggatagcctattctctctttggtggacagcctcttaccatattaggcagtacaggaccagttttggtgtttgaaaagattttgtttaaattttgcaaagaatatgggctgtcatacctatctttaagagctagcattggactttggactgcaactctatgtatcatacttgtggccacagatgctagttcccttgtctgctacatcactcggtttactgaagaagcttttgcttccctgatttgcatcattttcatttatgaggccctggagaagttgtttgaactcagtgaagcatatccaatcaacatgcataatgatctggaactgctgacacaatactcgtgtaactgtgtggaaccgcataatcccagcaatggcacattgaaggaatggagggaatccaatatttctgcctctgacataatttgggagaacctaactgtgtcagaatgcaaatcattgcatggagagtatgttggacgggcctgtggccatgatcacccatatgttccagatgttctattttggtctgtgatcctgttcttttccacagttactctgtcagccaccctgaagcagttcaagactagcagatattttccaaccaaggttcgatccatagtgagtgactttgctgtctttcttacaattctgtgtatggttttaattgactatgccattgggatcccatctccaaaactacaagtaccaagtgttttcaagcccactagagatgatcgtggctggtttgttacgcctttaggtccaaacccatggtggacagtaatagctgctataattccagctctgctttgtactattctaatttttatggaccaacagattacagctgtcatcatcaacaggaaagagcataagctaaagaaaggttgtgggtaccatctggacctattaatggtggctgtcatgctcggtgtatgctccatcatgggcctgccatggtttgtggctgccacagtcctctccatcactcatgtcaatagcctaaaactggaatcagaatgctcagctccaggagaacaacccaaatttctcggcattcgggagcaaagggttactgggcttatgatttttattcttatgggttcatcagtctttatgaccagtattctgaagtttattcccatgccagtgctatatggagtgtttctttatatgggtgcttcatctctaaagggaattcagttctttgataggataaagctcttctggatgccggcaaaacatcaaccagattttatatacctaaggcacgtaccgcttcgaaaagtgcatctcttcacaattattcagatgagttgccttggccttttgtggataataaaagtttcaagagctgctattgtctttcccatgatggtgttagccctggtatttgtaagaaagttgatggacttgttgttcacgaagcgggaactcagctggttggatgatttgatgcccgagagtaagaaaaagaaactggaagatgctgaaaaagaagaagaacaaagtatgctagctatggaagatgagggcacagtacaactcccattggaagggcactatagagatgatccatctgtgatcaatatatctgatgaaatgtcaaagactgccttgtggaggaaccttctgattactgccgataactcaaaagataaggagtcaagctttccttccaaaagcattgaaagccgaaaagagaagaaagctgactcagggaaaggtgttgacagggagacttgtctatga

SEQ ID NO: 29193 - DNA, 1841 bp, Homo sapiens
gcaattgcctcctgcttcagagctacctgatccgaatactaagcagagcgagtgccgggctgagtgtaagacactgaagacactgcagagcaaggtgcttattccagaggcgttacaaaacatggagattaaagaccagggagcccaaatggagccgctgctgcctacgagaaatgatgaagaagcagttgtggatagaggtggaactcgttctattctcaaaacacactttgagaaagaagatttagaaggtcatcgaacactatttattggagtacatgtgcccttgggaggaagaaaaagccatcgacgtcacaggcatcgtggtcataaacacagaaagagagacagagaaagagattcaggattagaggatggaagggagtcaccttcttttgacaccccatcacagagggtacagtttattcttggaaccgaggatgatgacgaggaacacattcctcatgaccttttcacagaactggatgagatttgttggcgtgaaggtgaggacgctgagtggcgagaaacagccaggtggttgaagtttgaagaagatgtggaagatggaggagaaaggtggagcaagccttatgtggctactctttcattgcacagcttgtttgaattgagaagttgtattctgaatggaactgtgttgctggacatgcatgccaacactttagaagaaattgcagatatggttcttgaccaacaagtgagctcaggtcagctgaatgaagatgtacgccatagggtccatgaggcattgatgaaacagcatcatcatcagaatcagaaaaaactcaccaacaggattcccattgttcgttcctttgctgatattggcaagaaacagtcagaaccaaattccatggacaaaaatgcaggtcaggttgtttctcctcagtctgctccagcctgtgttgaaaataaaaatgatgttagcagagaaaacagcactgttgactttagcaagggactgggaggccaacaaaaggggcatactagtccatgtgggatgaaacaaaggcatgaaaaaggacctccacaccagcaagagagagaggttgatctgcattttatgaaaaagattcctccaggtgctgaagcatcgaacatcttagtgggagaactggagttcttggatcgaacagtagttgcgtttgtcaggttgtctccagctgtattgcttcaaggactggctgaagtcccaatcccaaccaggtatttcatgatgttgcctataaagctaaagatcgtaatgacttggtatcaggaattgatgagtttctggatcaggttactgttctccctcctggagaatgggatccaagcattcgaatagagcctcccaaaaatgttccttcccaggagaagaggaagattcctgctgtaccaaatggaacagcagctcatggggaagcagagccccacggaggacatagtggacctgaactccagcgaactggaaggtcaccaatatccggtatcttcgcttctccagagttcttccacagattctgttgctgacatgacttgaagtatccattactcatctgctctcctggagttgctggtgtacatctgggctgctcttgcactgttctctgatttttgggggacttattttagatatcaaaagaaaagctccatacttctggagtgacttcagagatgctttcagcctgcagtgcttagcatcttttctatttctctactgcgcgtgtatgtctcctgtcatcacgtttggaggactgctgggagaagcaactgaagggcgtataagtgcaattgaatctctctttggagcatccatgaccgggatagcctattctctc

SEQ ID NO: 29194 - DNA, 3094 bp, Homo sapiens
ctttctccctagggtggcgtgggttgcatccctcggaagagcgaaggaatgagccaggtcggggggcggggagacaggtgcacacaggaggtccagggcttggtccatggggctggtgacctttctgcttcccttgcagaaaactctcccaccatgtcgcagaatggatacttcgaggattcaagctactacaagtgtgacacagatgacaccttcgaagcccgagaggagatcctgggggatgaggccttcgacactgccaactcctccatcgtgtctggcgagagtatccgtttttttgtcaatgtcaaccttgagatgcaggccaccaacactgagaatgaagcgacttccggtggctgtgtgctcctgcacacctcccgaaagtacctgaagttaaagaacttcaaggaagagatccgtgcgcaccgcgacctagatggcttcctggcgcaggccagcatcgtcctgaacgagacggccacctccctggataacgtgctgcggaccatgcttcgccgcttcgccagggaccctgacaacaatgagcccaactgcaacctggacctgctcatggccatgctcttcaccgatgccggggcacccatgcggggtaaagtccacctgctgtcagataccatccaaggggtcaccgccacagtgacaggggtgcggtaccagcagtcgtggctctgcatcatctgtaccatgaaggccctacagaagcggcacgtgtgcatcagccgcctggttcgcccacagaactggggggagaattcctgtgaggttcggttcgtcatcctggtgctggccccacccaagatgaaaagcactaagactgcgatggaggtggcgcgcacgtttgccaccatgttctcggatatcgccttccgccagaagctcctggagacccgcacagaggaggaattcaaggaggccttggtgcatcagagacagctgctcaccatggtgagccacggtccagtggcgccgagaacgaaggaacgcagcacagtctccctccctgcccacagacacccagagcccccaaagtgcaaggactttgtcccttttgggaagggcatccgggaggacatcgcacgcaggttccccttgtaccccttggacttcactgatggcattattgggaaaaacaaggctgtgggcaaatacatcaccaccaccctgttcctctacttcgcctgcctcctgcccaccatcgctttcgggtctctcaatgacgagaacacagacggggccatcgacgtgcagaagaccatagccgggcagagcatcgggggcctgctctacgcgctcttctctgggcagccattggtgattctgctgaccaccgcgcccctggcgctctacatccaggtgattcgtgtcatctgtgatgactatgacctggacttcaactccttctacgcatggacgggcctgtggaatagtttcttccttgcgctttatgcctttttcaacctcagcctggtcatgagtctcttcaagaggtcgacggaggagatcatcgccctcttcatttccatcacgtttgtgctggatgccgtcaagggcacggttaaaatcttctggaagtactactatgggcattacttggacgactatcacacaaaaaggacttcatcccttgtcagcctgtcaggcctcggcgccagcctcaacgccagcctccacactgccctcaacgccagcttcctcgccagccccacggagctgccctcggccacacactcaggccaggcgaccgccgtgctcagcctcctcatcatgctgggcacgctctggctgggctacaccctctaccaattcaagaagagcccctacctgcacccctgcgtgcgagagatcctgtccgactgcgccctgcccatcgcggtgctcgccttctccctcatcagctcccatggcttccgggaaatcgagatgagcaagttccgctacaaccccagcgagagcccctttgcgatggcgcagatccagtcgctgtccctgagggccgtcagcggtgccatgggcctcggcttcctgctgtccatgctcttcttcatcgagcagaacttggtggccgccttggtgaatgcaccggagaacaggctggtgaagggcactgcctaccactgggacctcctgctcctcgccatcatcaacacagggctgtctctgtttgggctgccttggatccatgccgcctacccccactccccgctgcacgtgcgagccctggccttagtggaggagcgtgtggagaacggacacatctatgacacgattgtgaacgtgaaggagacgcggctgacctcgctgggcgccagcgtcctggtgggcctgtccctgttgctgctgccggtcccgcttcagtggatccccaagcccgtgctctatggcctcttcctctacatcgcgctcacctccctcgatggcaaccagctcgtccagcgcgtggccctgctgctcaaggagcagactgcgtaccccccgacacactacatccggagggtgccccagaggaagatccactacttcacgggcctgcaggtgcttcagctgctgctgctgtgtgccttcggcatgagctccctgccctacatgaagatgatctttcccctcatcatgatcgccatgatccccatccgctatatcctgctgccccgaatcattgaagccaagtacttggatgtcatggacgctgagcacaggccttgactggcagaccctgcccacgccccattcgccagccctccacgtcctcccaggctggctctggagctgtgaggggaggtgtaggtgtgtgggtgactgctctgtgctgcgccttctcatggctgactcaggcctggggcatctgggcattgtaggggtgcagtggtatgtgcccacccctctcccattatcctttagctttaggccaagagcgttgctcagggcagcttctgcccagggtgggtgggactgagcaggatggattttcttttgataaaagagtcgatgcctgaaagagaaaccatttccttgattgtgtaaggaacttgctggacgcacattagagaataaagctcctgtttctaggctccta

SEQ ID NO: 29195 - DNA, 3229 bp, Homo sapiens
cttccaggcggccgggacgcggtcccaggactggagaccgttgcctgtcggcccccgtgtgacccggggcgcgtgacgggggtcgggggaactgcgcctgcaatgggcgtttatggcccccaggaccggtctgagagtgagaagagggatgtgcagagagatcccccgccttggcatccgaggagagagggggagaggcccgctcgggcccggtcccttcctctcgctgcagcggggcagggttttctcaggaaaacctggattagcgaacatgaaaactctcccaccatgtcgcagaatggatacttcgaggattcaagctactacaagtgtgacacagatgacaccttcgaagcccgagaggagatcctgggggatgaggccttcgacactgccaactcctccatcgtgtctggcgagagtatccgtttttttgtcaatgtcaaccttgagatgcaggccaccaacactgagaatgaagcgacttccggtggctgtgtgctcctgcacacctcccgaaagtacctgaagttaaagaacttcaaggaagagatccgtgcgcaccgcgacctagatggcttcctggcgcaggccagcatcgtcctgaacgagacggccacctccctggataacgtgctgcggaccatgcttcgccgcttcgccagggaccctgacaacaatgagcccaactgcaacctggacctgctcatggccatgctcttcaccgatgccggggcacccatgcggggtaaagtccacctgctgtcagataccatccaaggggtcaccgccacagtgacaggggtgcggtaccagcagtcgtggctctgcatcatctgtaccatgaaggccctacagaagcggcacgtgtgcatcagccgcctggttcgcccacagaactggggggagaattcctgtgaggttcggttcgtcatcctggtgctggccccacccaagatgaaaagcactaagactgcgatggaggtggcgcgcacgtttgccaccatgttctcggatatcgccttccgccagaagctcctggagacccgcacagaggaggaattcaaggaggccttggtgcatcagagacagctgctcaccatggtgagccacggtccagtggcgccgagaacgaaggaacgcagcacagtctccctccctgcccacagacacccagagcccccaaagtgcaaggactttgtcccttttgggaagggcatccgggaggacatcgcacgcaggttccccttgtaccccttggacttcactgatggcattattgggaaaaacaaggctgtgggcaaatacatcaccaccaccctgttcctctacttcgcctgcctcctgcccaccatcgctttcgggtctctcaatgacgagaacacagacggggccatcgacgtgcagaagaccatagccgggcagagcatcgggggcctgctctacgcgctcttctctgggcagccattggtgattctgctgaccaccgcgcccctggcgctctacatccaggtgattcgtgtcatctgtgatgactatgacctggacttcaactccttctacgcatggacgggcctgtggaatagtttcttccttgcgctttatgcctttttcaacctcagcctggtcatgagtctcttcaagaggtcgacggaggagatcatcgccctcttcatttccatcacgtttgtgctggatgccgtcaagggcacggttaaaatcttctggaagtactactatgggcattacttggacgactatcacacaaaaaggacttcatcccttgtcagcctgtcaggcctcggcgccagcctcaacgccagcctccacactgccctcaacgccagcttcctcgccagccccacggagctgccctcggccacacactcaggccaggcgaccgccgtgctcagcctcctcatcatgctgggcacgctctggctgggctacaccctctaccaattcaagaagagcccctacctgcacccctgcgtgcgagagatcctgtccgactgcgccctgcccatcgcggtgctcgccttctccctcatcagctcccatggcttccgggaaatcgagatgagcaagttccgctacaaccccagcgagagcccctttgcgatggcgcagatccagtcgctgtccctgagggccgtcagcggtgccatgggcctcggcttcctgctgtccatgctcttcttcatcgagcagaacttggtggccgccttggtgaatgcaccggagaacaggctggtgaagggcactgcctaccactgggacctcctgctcctcgccatcatcaacacagggctgtctctgtttgggctgccttggatccatgccgcctacccccactccccgctgcacgtgcgagccctggccttagtggaggagcgtgtggagaacggacacatctatgacacgattgtgaacgtgaaggagacgcggctgacctcgctgggcgccagcgtcctggtgggcctgtccctgttgctgctgccggtcccgcttcagtggatccccaagcccgtgctctatggcctcttcctctacatcgcgctcacctccctcgatggcaaccagctcgtccagcgcgtggccctgctgctcaaggagcagactgcgtaccccccgacacactacatccggagggtgccccagaggaagatccactacttcacgggcctgcaggtgcttcagctgctgctgctgtgtgccttcggcatgagctccctgccctacatgaagatgatctttcccctcatcatgatcgccatgatccccatccgctatatcctgctgccccgaatcattgaagccaagtacttggatgtcatggacgctgagcacaggccttgactggcagaccctgcccacgccccattcgccagccctccacgtcctcccaggctggctctggagctgtgaggggaggtgtaggtgtgtgggtgactgctctgtgctgcgccttctcatggctgactcaggcctggggcatctgggcattgtaggggtgcagtggtatgtgcccacccctctcccattatcctttagctttaggccaagagcgttgctcagggcagcttctgcccagggtgggtgggactgagcaggatggattttcttttgataaaagagtcgatgcctgaaagagaaaccatttccttgattgtgtaaggaacttgctggacgcacattagagaataaagctcctgtttctaggctccta

SEQ ID NO: 29196 - DNA, 1020 bp, Homo sapiens
gtcgccgagtttggggtccagaagcgccggagcgccgcgtgaggagcccggccgtgagtgcgcgagtgtgccatggccgcggccaccaggcgcgtgttccatctgcagccgtgcgaaaactctcccaccatgtcgcagaatggatacttcgaggattcaagctactacaagtgtgacacagatgacaccttcgaagcccgagaggagatcctgggggatgaggccttcgacactgccaactcctccatcgtgtctggcgagagtatccgtttttttgtcaatgtcaaccttgagatgcaggccaccaacactgagaatgaagcgacttccggtggctgtgtgctcctgcacacctcccgaaagtacctgaagttaaagaacttcaaggaagagatccgtgcgcaccgcgacctagatggcttcctggcgcaggccagcatcgtcctgaacgagacggccacctccctggataacgtgctgcggaccatgcttcgccgcttcgccagggaccctgacaacaatgagcccaactgcaacctggacctgctcatggccatgctcttcaccgatgccggggcacccatgcggggtaaagtccacctgctgtcagataccatccaaggggtcaccgccacagtgacaggggtgcggtaccagcagtcgtggctctgcatcatctgtaccatgaaggccctacagaagcggcacgtgtgcatcagccgcctggttcgcccacagaactggggggagaattcctgtgaggttcggttcgtcatcctggtgctggccccacccaagatgaaaagcactaagactgcgatggaggtggcgcgcacgtttgccaccatgttctcggatatcgccttccgccagaagctcctggagacccgcacagaggaggaattcaaggaggccttggtgcatcagagacagctgctcaccatggtgagccacggtccagtggcgccgagaacgaaggaacgcagcacagtctccctccctgcccacagacacccagag

SEQ ID NO: 29197 - DNA, 3101 bp, Homo sapiens
gtgtcgccggctcccgccgccggcccgcccgagtcgccgagtttggggtccagaagcgccggagcgccgcgtgaggagcccggccgtgagtgcgcgagtgtgccatggccgcggccaccaggcgcgtgttccatctgcagccgtgcgaaaactctcccaccatgtcgcagaatggatacttcgaggattcaagctactacaagtgtgacacagatgacaccttcgaagcccgagaggagatcctgggggatgaggccttcgacactgccaactcctccatcgtgtctggcgagagtatccgtttttttgtcaatgtcaaccttgagatgcaggccaccaacactgagaatgaagcgacttccggtggctgtgtgctcctgcacacctcccgaaagtacctgaagttaaagaacttcaaggaagagatccgtgcgcaccgcgacctagatggcttcctggcgcaggccagcatcgtcctgaacgagacggccacctccctggataacgtgctgcggaccatgcttcgccgcttcgccagggaccctgacaacaatgagcccaactgcaacctggacctgctcatggccatgctcttcaccgatgccggggcacccatgcggggtaaagtccacctgctgtcagataccatccaaggggtcaccgccacagtgacaggggtgcggtaccagcagtcgtggctctgcatcatctgtaccatgaaggccctacagaagcggcacgtgtgcatcagccgcctggttcgcccacagaactggggggagaattcctgtgaggttcggttcgtcatcctggtgctggccccacccaagatgaaaagcactaagactgcgatggaggtggcgcgcacgtttgccaccatgttctcggatatcgccttccgccagaagctcctggagacccgcacagaggaggaattcaaggaggccttggtgcatcagagacagctgctcaccatggtgagccacggtccagtggcgccgagaacgaaggaacgcagcacagtctccctccctgcccacagacacccagagcccccaaagtgcaaggactttgtcccttttgggaagggcatccgggaggacatcgcacgcaggttccccttgtaccccttggacttcactgatggcattattgggaaaaacaaggctgtgggcaaatacatcaccaccaccctgttcctctacttcgcctgcctcctgcccaccatcgctttcgggtctctcaatgacgagaacacagacggggccatcgacgtgcagaagaccatagccgggcagagcatcgggggcctgctctacgcgctcttctctgggcagccattggtgattctgctgaccaccgcgcccctggcgctctacatccaggtgattcgtgtcatctgtgatgactatgacctggacttcaactccttctacgcatggacgggcctgtggaatagtttcttccttgcgctttatgcctttttcaacctcagcctggtcatgagtctcttcaagaggtcgacggaggagatcatcgccctcttcatttccatcacgtttgtgctggatgccgtcaagggcacggttaaaatcttctggaagtactactatgggcattacttggacgactatcacacaaaaaggacttcatcccttgtcagcctgtcaggcctcggcgccagcctcaacgccagcctccacactgccctcaacgccagcttcctcgccagccccacggagctgccctcggccacacactcaggccaggcgaccgccgtgctcagcctcctcatcatgctgggcacgctctggctgggctacaccctctaccaattcaagaagagcccctacctgcacccctgcgtgcgagagatcctgtccgactgcgccctgcccatcgcggtgctcgccttctccctcatcagctcccatggcttccgggaaatcgagatgagcaagttccgctacaaccccagcgagagcccctttgcgatggcgcagatccagtcgctgtccctgagggccgtcagcggtgccatgggcctcggcttcctgctgtccatgctcttcttcatcgagcagaacttggtggccgccttggtgaatgcaccggagaacaggctggtgaagggcactgcctaccactgggacctcctgctcctcgccatcatcaacacagggctgtctctgtttgggctgccttggatccatgccgcctacccccactccccgctgcacgtgcgagccctggccttagtggaggagcgtgtggagaacggacacatctatgacacgattgtgaacgtgaaggagacgcggctgacctcgctgggcgccagcgtcctggtgggcctgtccctgttgctgctgccggtcccgcttcagtggatccccaagcccgtgctctatggcctcttcctctacatcgcgctcacctccctcgatggcaaccagctcgtccagcgcgtggccctgctgctcaaggagcagactgcgtaccccccgacacactacatccggagggtgccccagaggaagatccactacttcacgggcctgcaggtgcttcagctgctgctgctgtgtgccttcggcatgagctccctgccctacatgaagatgatctttcccctcatcatgatcgccatgatccccatccgctatatcctgctgccccgaatcattgaagccaagtacttggatgtcatggacgctgagcacaggccttgactggcagaccctgcccacgccccattcgccagccctccacgtcctcccaggctggctctggagctgtgaggggaggtgtaggtgtgtgggtgactgctctgtgctgcgccttctcatggctgactcaggcctggggcatctgggcattgtaggggtgcagtggtatgtgcccacccctctcccattatcctttagctttaggccaagagcgttgctcagggcagcttctgcccagggtgggtgggactgagcaggatggattttcttttgataaaagagtcgatgcctgaaagagaaaccatttccttgattgtgtaaggaacttgctggacgcacattagagaataaagctcctgtttctaggctcct

SEQ ID NO: 29198 - DNA, 1480 bp, Homo sapiens
acaaacagagcttggttttagccagggcgcccactgcagtcacgctggagacctctggtgcagatgggcgagactggacccagctttccagctttcttcccctttccataattctcctgaaagtgtaagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctcgcagaagtgatggttcggctgacttggcaccaggccctggatcctgacaaccactgcatcccctaccttacagggctgggggacctgctcggtactggcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctct

SEQ ID NO: 29199 - DNA, 4997 bp, Homo sapiens
ccaccggcagccaaccagttgggcccgagtccgcgggcaagaagcgattgggggcgcgtgagctcggctccccggtcccccgtccgggtgcccccccgccgggcccgaagcgatatatcctgccctccccggccacctcccccgcgtggaagcggagcggcggcctcgctgtaacgcagaagcgaaatgtagcgagccgggtgtcgcggctggacgctcgccttggctgggggtgtgggggggcacgccgggggccaaggaggactgtcgaggaggagtgatgagaagagggggtgccctgcaccccccgagaccacgggccacgctgccacttgccaggcgccccccttcctcccaggcgaggggcaggtgttccacactgattctcgtgactttaaggaccagggatttgaagaggtattagctcttcccaggaagggaggaagtttctggaagagaagggaaagacggcagacgctgcgctgggaccagcagagcctgaggagctgtgggaagctgacagagcccagccaaaggagcgggaaggagccgcagccccaggctggcactgtgttctgaaagatttgaactcaagctgctttttacggaagaggggccacttcagagggcaccccagaatttggttgagctcttctactctggatgccccctgctctgaggagcctgccactgagaaccaaagaagataagaggacagatactttttcttcaagcacagagctggtgggttggagtcaggcatctgcacccctagtggctgtctggtgaggaatttcttgtttcttcccagcttgcggcttcagtgcttgatggggctgcctgttggtggatcagtttttgcagtgcctggtaggagtggagagccgtgggaagaggtcctgcggcgcccaagcctgggttcaccccaagactaagttctttcccaagttagagaagaagagagaaagcaaaaagaagagaggaaagttctcccttcccctcctccgtgcctgtcatgtcctctaagccagagccgaaggacgtccaccaactgaacgggactggcccttctgcctctccctgctcttcagatggcccagggagagagcccttggctgggacctcagagttcctggggcctgatggggctggggtagaggtggtgattgagtctcgggccaacgccaagggggttcgggaggaggacgccctgctggagaacgggagccagagcaacgaaagtgacgacgtcagcacagaccgtggccctgcgccaccttccccgctcaaggagacctccttttccatcgggctgcaagtactgtttccattcctcctggcaggctttgggaccgtggctgctggcatggtgttggacatcgtgcagcactgggaagtcttccagaaggtgacagaggtcttcatcctagtgcctgcgctgctggggctcaaagggaacctggaaatgaccctggcatcaaggctttccactgcagccaacattggacacatggacacacccaaggagctctggcggatgatcactgggaacatggccctcatccaggtgcaggccacggtggtgggcttcctggcgtccatcgcagccgtcgtctttggctggatccctgatggccacttcagtattccgcacgccttcctgctctgtgctagcagcgtggccacagccttcattgcctccctggtactgggtatgatcatgattggagtcatcattggctctcgcaagattgggatcaacccagacaacgtggccacacccattgctgccagcctgggcgacctcatcaccttggcgctgctctcaggcatcagctggggactctacctggaactgaatcactggcgatacatctacccactggtgtgtgctttctttgtggccctgctgcctgtctgggtggtgctggcccgacgaagtccagccacaagggaggtgttgtactcgggctgggagcctgttatcattgccatggccatcagcagtgtgggaggcctcatcttggacaagactgtctcagaccccaactttgctgggatggctgtcttcacgcctgtgattaatggtgttgggggcaatctggtggcagtgcaggccagccgcatctccaccttcctgcacatgaatggaatgcccggagagaactctgagcaagctcctcgccgctgtcccagtccttgtaccaccttcttcagccctgatgtgaattctcgctcagcccgggtcctcttcctcctcgtggtcccaggacacctggtgttcctctacaccatcagctgtatgcagggcgggcacaccaccctcacactcatcttcatcatcttctatatgacagctgcactgctccaggtgctgattctcctgtacatcgcagactggatggtgcactggatgtggggccggggcctggacccggacaacttctccatcccatacttgactgctctgggggacctgcttggcactgggctcctagcactcagcttccatgttctctggctcataggggaccgagacacggatgtcggggactagcttggtcactcaacattttccccatccctctgcactttctatttgaaatttttcttttgttcccctgtccctcctccaccccacactcccacctctttctaggacttcactttgataccaaattctcattattttcaatgggaatttttatacattgagccaagtttgtatagcaagaatttgggaaacacagatggcctgagataagcagtacaagtaggtttttgagacaatcaccaagtgcagtttcatggtgggtgcctccaggtgatgtggactggagcaggggagttttgtctggaatctggggacatggggtttggctttagcaacctgtcttggccctaatgagaaaccctttgtaagtgggctctggatttttggttttgttttctttttatctgttttgttttatttttggttttggttgaacagagggacagaagaataagtaacactcccaaacacagacatacttttgtagaagtggaccaacttcaaagctctggacaggagacacctgctccaggcccctgtgatcccagttctgttctcttgccctctggacctaagcgttcccactcgcagaaagagtaaggtggactgacttttcaatttgtgcacatgcctcttgttcaatggcctggtcaacatcaacaacccctccctctgatcatttccagttgattgtcatatccaggaaaaaatggaacagtgcactcttctccctgttgacccatgtccacctattggttccccaaaatccacattctccctgggcccaaatgactttgtctccctgggcccagattctttgtctctcttcaaccttcatctcaaattgtctctaagcactaccttccccagagcttgccaggttgggttttgagattagggtcaggtcatgggtatgtggagaatggtttggaggttgaggacaaccacaggtgtctcattgctgccatttctcctgaggacataatcacttggtcaccttggaccctgtcacttcctaaaattactcgttctgtcatgccatagaggtcagttttcctctttcttggcttctacccacaaacattcaccaatcatttattcgttcatttagcaaatatgcagcctccgcaagatgagctctcctgcagacaagcatggtctgaaacattctttgagcaatatttattgagtgcctactatgtgttaggtactgtgccaggcactgataagccagtggtaagggaaacacagctctaacctcacctcattctccaggttacaaaggccatgtgcccctttgaatctggcagagaaagtttcctcgttgtaagtatttgcatctacttcaagccagattcttctgcctctttctcctttccagacccctactctgtgcagtgctgaccacagctagagccaccgccccattgctcaaccagtatttatttccctaaacgacccttcctcacattcccttccctccacctctccttaccaagcacccaaaagaggatttagaactagcagggtggacatcatctggttgtttctacttttctctgcctagcacaaaattgggagaaaactggagcctccatccgcagtcacacgtgtacagatctggggatttggatgtaggctttttctaacttctctctcagaagcttctacagaaacccttccatctgtagcctcaagggcccacctccaagggaaggcttaggcaatgatcctgtttctaccaacactgcaccttatcccaggaacctgccctagacctccagagaccatattttctctccctccatttctacccagacctccaggcctccttctggaatcatagaaccgtagaattggaaggaattttagaggttttctagttggagttgtgtccaacagaattcattaacaccagcctgggcttgtttttcctcctccctctggacttttttcatcttttcctccacctcaaaaaatacttacacacagattcttcttgtacaggcatcaaaaccaactcctctgcccctaaggctgtgtccctgtggtctccagccacccctaccccagtcactcgccccttcctcatctctggaatttggccaggcagtcccagaagactctggagtgacctcctttgcctaaaaagcagacagataggcatgccccaggccctgagtgagcagaggaggactgtagggtgagagggaaagaaaatgaaggtgactttcatggaagtttcatttcttttccccgattgtaccaactgcatgtacttttggcctggctgcaaggagcaatattggtttactctcgtatccttaaaaagttacagaactgtgtcttaagagaattatttatagttactataactgaattgacaaatgtcaacttaactgataaattatatttggtaaaataaagaggacgtttatttaga

SEQ ID NO: 29200 - DNA, 4449 bp, Homo sapiens
gtggaaatattttctacacaatgaagtcaacaacttaatttaaaccagtgtttgtgcggttctgattcatctgctgtggttcccgaagcttgagatctaaggagtacagggtcttttgtgatgacaatatgactaatagtaaaggaagatctattaccgataaaacaagtggtggtccaagtagtggaggaggttttgtagattggactttacgtttaaacacaattcaatccgacaagtttttaaatttactcttgagtatggttccagtgatttaccagaaaaaccaagaagacaggcacaaaaaagcaaacggcatttggcaagatggattatcaactgcagtacagacttttagtaatagatctgagcaacacatggagtatcacagtttctcagagcagtcttttcatgccaataatgggcacgcatcatcaagctgcagccaaaagtatgatgactatgccaattataattactgtgatggaagggagacttcagaaaccactgccatgttacaagatgaagatatatctagtgatggtgatgaagatgctattgtagaagtgaccccaaaattaccaaaggaatccagtggcatcatggcattgcaaatacttgtgccctttttgctagctggttttggaacagtttcagctggcatggtactggatatagtacagcactgggaggtgttcagaaaagttacagaagttttcattttagtccctgcacttcttggtctcaaagggaacttggaaatgacattggcatccagattatccactgcagtaaatattgggaagatggattcacccattgaaaagtggaacctaataattggcaacttggctttaaagcaggttcaggcaacagtagtgggttttctagcagctgtggcagcaattatattgggctggattccagaaggaaaatattaccttgatcattccatacttctgtgctctagcagtgtggcaactgccttcattgcatctcttctgcagggaataataatggttggggttatcgttggttcaaagaagactggtataaatcctgataatgttgctacacccattgctgctagttttggcgaccttataactcttgccatattggcttggataagtcagggcttatactcctgtcttgagacctattactacatttctccattagttggtgtatttttcttggctctaacccctatttggattataatagctgccaaacatccagccacaagaacagttctccactcaggctgggagcctgtcataacagctatggttataagtagcattgggggccttattctggacacaactgtatcagacccaaacttggttgggattgttgtttacacgccagttattaatggtattggtggtaatttggtggccattcaggctagcaggatttctacctacctccatttacatagcattccaggagaattgcctgatgaacccaaaggttgttactacccatttagaactttctttggtccaggagtaaataataagtctgctcaagttctactgcttttagtgattcctggacatttaattttcctctacactattcatttgatgaaaagtggtcatacttctttaactataatcttcatagtagtgtatttatttggcgctgtgttacaggtatttaccttgctgtggattgctgactggatggtccatcacttctggaggaaaggaaaggacccggatagtttctccatcccctacctaacagcattgggtgatctgctcgggacagctctgttagccttaagttttcattttctttggcttattggagatcgagatggagatgttggagactaataaattctacaaactgctctcaagttaccaaggaagaaaatacacgacaaccacttatggctctttttcaaaactcttaaatcagtagtttgacttttgccagggtaatcttcagttggccctgattcaattaaatggccttaatttttttttaaggaatttgtgtcaaaaccagaatgaagagtattcgtgctgcttttcatagaataaatgataatttgacatagacatagatataagttccagctctgaaattaattaggaaagaatataggatgtttacagtgaataattttaaaaccacaaacatagcagaaatgtactttattattaaatttgtaatgcaggattagaagaagcagagctctagtttagcctttcttgtctcacagatgtgctgtatcccaggcatactataaaacgaagagtgcccaaccaagctttgaatcgtattaacaatgcccacctctatgctagctgaggataaatttaccagttgctcatatttaaactgacctaaatatgttttgctgagcataagataaactcacttttacctccatctaaaattatcctgttctgatgccaattcaatttcagctctgcaagttcttgtcaggctaatctttaaacattgagtgatcttgagagattgttaatgaaagcagtgagtcattttttgatgattgatttgttggaaaaatgttgatgtgttttaaaaaatgtaatcttcaaaaacagaatataacctgagatgcatttgtagagacaagacggtacgagaatgtgtgtgtgtgtgtgtgtgagagagagagacttttgatgaagaactaaatcttggattgctgatagcaaagatcatagtgctgttggaatatcagcaatatagagttattcttaaacacattctattaacatgtttttgtcattgggtccaaaaattttgctgctgaccagaatttactatttgttacctatattctttttttttttttttttttttttttttgagacagagtcttgctctgtcgcccaggctggaatgcagtggtgtgatctcggctcactgctacctccacctcctggattcaagtgattctcctgcctcagcctcccgagtagctgggattacaggaatgcgccacaacgcccagctaatttgttacctacactctaattaataattaataatttcttattttaaaaagtagtactatttaatataatcaagataggagatttaaaatgagcaagtgattcatttgctcttttaaagaagcccgttgacttacgcttttaaaaaagaagttggtgggttacctcaattattgttcatgcttaaacatatccatttgtacaggcttatttctacgtgggacccaatcatatatactatatttctcaaataatttttctaaaactctggcctatattctaaacacttgaccaacaccttagttattgaataggtaaccatttttaaagtacatgtggttcattttttaaaattcaatctctcaagaccgttagatatttaataatttaagctgataagggtatcaaaatgcacattaactttgatcatcatgatttaagttgtaactttgtgttattatataaatattaggttgtttataaatatattgcagaaagtattcttgttaagctcttttaaatgaggggactgtggtttagagttatatatttttgcttatttttaaacttcaattattccattcttctgccttataataaaacttttaaggcagagaactgaactaattatagaatttctcctttggagagttataatgttacatagtgaacattcttataaaagaaagaataagtttaagttgatgaatatttagctgcaaagattttttacttaaaaaaatccatgaatatctttgattttattataaagcatttgtaaattatttgcatttgagctgtaagattcataaacatttacatttcccaatgatttctattttgatttttaaaaaatatacagggcaagctacatttttaaagcattaatcaacaactttattatattacacattccagtgcacaaacacacaatatcatttaatactcacagtagtacctgtgaaatatatcagatggatattcctatctctattttacagcagaggaaaccgaaattcagagaacttacatttctaaggttgtacagctgcaaaatgaccaaattgtgaagtccctaacatccaggttttcataatgccagtactctttctatgacatgtttatgaccctccaaatgtaccaaaactacctaactaattcactgagaggaagccaactgcaaaaataggatttttaaaagtacaatagagtattactacattttatggatttcagacaaagaaacctccgtttattatatcctgatggtgagtattgccagctctaaattattcatatttctaagaccaaggaaaatataggtaaatgaaaattttgaaataaagaacaatgccttaatttgtaaaatctatcattgctaccaccctgcccaggtctggccatttgccataaatgctggtaaataaatacaatgactgataga

SEQ ID NO: 29201 - DNA, 571 bp, Homo sapiens
gatcagtggtaaaagaagttacgaacagttcataaaagatccagtccttctgtggaacttctgaacatcttttattagtggaaatattttctacacaatgaagtcaacaacttaatttaaaccagtgtttgtgcggttctgattcatctgctgtggttcccgaagcttgagatctaaggagtacagggtcttttgtgatgacaatatgactaatagtaaaggaagatctattaccgataaaacaagtggtggtccaagtagtggaggaggttttgtagattggactttacgtttaaacacaattcaatccgacaagtttttaaatttactcttgagtatggttccagtgatttaccagaaaaaccaagaagacaggcacaaaaaagcaaacggcatttggcaagatggattatcaactgcagtacagacttttagtaatagatctgagcaacacatggagtatcacagtttctcagagcagtcttttcatgccaataatgggcacgcatcatcaagctgcagccaaaagtatgatgactatgccaattataattactgtgatggaagggag

SEQ ID NO: 29202 - DNA, 702 bp, Homo sapiens
gctgtcagcttggggccgcagccgcgcgaggaggcgcgggagcaggaaggagctgtgggctgggagccgctgtcctccccgccaccaccggtgccgggcaccagatccagtccttctgtggaacttctgaacatcttttattagtggaaatattttctacacaatgaagtcaacaacttaatttaaaccagtgtttgtgcggttctgattcatctgctgtggttcccgaagcttgagatctaaggagtacagggtcttttgtgatgacaatatgactaatagtaaaggaagatctattaccgataaaacaagtggtggtccaagtagtggaggaggttttgtagattggactttacgtttaaacacaattcaatccgacaagtttttaaatttactcttgagtatggttccagtgatttaccagaaaaaccaagaagacaggcacaaaaaagcaaacggcatttggcaagatggattatcaactgcagtacagacttttagtaatagatctgagcaacacatggagtatcacagtttctcagagcagtcttttcatgccaataatgggcacgcatcatcaagctgcagccaaaagtatgatgactatgccaattataattactgtgatggaagggagacttcagaaaccactgccatgttacaagatgaagatatatctagtgatggtgatgaagatgctat

SEQ ID NO: 29203 - DNA, 563 bp, Homo sapiens
agtctgcaagaaacatgacctcagccaaaaagaggccgctggtctgagaagagaaatcatgagtcatggattcgggggttcggaccttggagcaggcgatcctcttctcatgtagacggctttcttccaagtggtggtgatgatggtggtggtagaaggagctttgtgaggaggaagacacagtgacagaaagtttcagaattaagtcattccaaaggaaagtcttcccccaaaggccttcccctctgaaatagccctatccagtccttctgtggaacttctgaacatcttttattagtggaaatattttctacacaatgaagtcaacaacttaatttaaaccagtgtttgtgcggttctgattcatctgctgtggttcccgaagcttgagatctaaggagtacagggtcttttgtgatgacaatatgactaatagtaaaggaagatctattaccgataaaacaagtggtggtccaagtagtggaggaggttttgtagattggactttacgtttaaacacaattcaatccgacaagtttttaaatttactcttgagtatggtt

SEQ ID NO: 29204 - DNA, 590 bp, Homo sapiens
gctgtcagcttggggccgcagccgcgcgaggaggcgcgggagcaggaaggagctgtgggctgggagccgctgtcctccccgccaccaccggtgccgggcaccaggtgaatgccccttccatcccccgcccctggtgtctcggtctggtctgaggagacggggacccttctcacaccggccgctgccgccgccgcgctccggaacagatccagtccttctgtggaacttctgaacatcttttattagtggaaatattttctacacaatgaagtcaacaacttaatttaaaccagtgtttgtgcggttctgattcatctgctgtggttcccgaagcttgagatctaaggagtacagggtcttttgtgatgacaatatgactaatagtaaaggaagatctattaccgataaaacaagtggtggtccaagtagtggaggaggttttgtagattggactttacgtttaaacacaattcaatccgacaagtttttaaatttactcttgagtatggttccagtgatttaccagaaaaaccaagaagacaggcacaaaaaagcaaacggcatttggcaagatggattatcaactgcag

SEQ ID NO: 29205 - DNA, 564 bp, Homo sapiens
cagcttggggccgcagccgcgcgaggaggcgcgggagcaggaaggagctgtgggctgggagccgctgtcctccccgccaccaccggtgccgggcaccaggtgaatgccccttccatcccccgcccctggtgtctcggtctggtctgaggagacggggacccttctcacaccggccgctgccgccgccgcgctccggaacagatcctcttctcatgtagacggctttcttccaagtggtggtgatgatggtggtggtagaaggagctttgtgaggaggaagacacagtgacagaaagtttcagaattaagtcattccaaaggaaagtcttcccccaaaggccttcccctctgaaatagccctatccagtccttctgtggaacttctgaacatcttttattagtggaaatattttctacacaatgaagtcaacaacttaatttaaaccagtgtttgtgcggttctgattcatctgctgtggttcccgaagcttgagatctaaggagtacagggtcttttgtgatgacaatatgactaatagtaaaggaagatctattaccgataaa

SEQ ID NO: 29206 - DNA, 685 bp, Homo sapiens
agggggccgcgggcgccgacggccgggctgtcagcttggggccgcagccgcgcgaggaggcgcgggagcaggaaggagctgtgggctgggagccgctgtcctccccgccaccaccggtgccgggcaccagatcctcttctcatgtagacggctttcttccaagtggtggtgatgatggtggtggtagaaggagctttgtgaggaggaagacacagtgacagaaagtttcagaattaagtcattccaaaggaaagtcttcccccaaaggccttcccctctgaaatagccctatccagtccttctgtggaacttctgaacatcttttattagtggaaatattttctacacaatgaagtcaacaacttaatttaaaccagtgtttgtgcggttctgattcatctgctgtggttcccgaagcttgagatctaaggagtacagggtcttttgtgatgacaatatgactaatagtaaaggaagatctattaccgataaaacaagtggtggtccaagtagtggaggaggttttgtagattggactttacgtttaaacacaattcaatccgacaagtttttaaatttactcttgagtatggttccagtgatttaccagaaaaaccaagaagacaggcacaaaaaagcaaacggcatttggcaagatggattatcaactgcagtacagactttt

SEQ ID NO: 29207 - DNA, 574 bp, Homo sapiens
actatgcgctgctgggccgaaagacacgtggttcggttttaactccagtctgcaagaaacatgacctcagccaaaaagaggccgctggtctgagaagagaaatcatgagtcatggattcggggatccagtccttctgtggaacttctgaacatcttttattagtggaaatattttctacacaatgaagtcaacaacttaatttaaaccagtgtttgtgcggttctgattcatctgctgtggttcccgaagcttgagatctaaggagtacagggtcttttgtgatgacaatatgactaatagtaaaggaagatctattaccgataaaacaagtggtggtccaagtagtggaggaggttttgtagattggactttacgtttaaacacaattcaatccgacaagtttttaaatttactcttgagtatggttccagtgatttaccagaaaaaccaagaagacaggcacaaaaaagcaaacggcatttggcaagatggattatcaactgcagtacagacttttagtaatagatctgagcaacacatggagtatcacagtttctcagagcagtcttttca

SEQ ID NO: 29208 - DNA, 1797 bp, Homo sapiens
cggctcccagccccccgggcccccggcggggctctgcgctgccggagcttgggcgtctgctgctgtcccggagcgccaagtcgtccgaggtccggccgcccggccggggcggggccagggaggcccggccttcccgcttcctgcctgagccgcaggcccgcccctgcgtcctccgcccgcctctttcccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctcgcagaagtgatggttcggctgacttggcaccaggccctggatcctgacaaccactgcatcccctaccttacagggctgggggacctgctcggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacag

SEQ ID NO: 29209 - DNA, 1705 bp, Homo sapiens
cggctcccagccccccgggcccccggcggggctctgcgctgccggagcttgggcgtctgctgctgtcccggagcgccaagtcgtccgaggtccggccgcccggccggggcggggccagggaggcccggccttcccgcttcctgcctgagccgcaggcccgcccctgcgtcctccgcccgcctctttcccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgcttctggactatttccaggccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctcgcagaagtgatggttcggctgacttggcaccaggccctggatcctgacaaccactgcatcccctaccttacagggctgggggacctgctcggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgtacttga

SEQ ID NO: 29210 - DNA, 2169 bp, Homo sapiens
gcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctcgcagaagtgatggttcggctgacttggcaccaggccctggatcctgacaaccactgcatcccctaccttacagggctgggggacctgctcggtactggcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctctggggttgatacctgagcctgcaatagagccctgaaatcaagagcatggcttgagtgtgtgaatatgatgtgtgcacatgcttaatgagcgtgcaagtgtgcacacgtttgtggagaggagggtgttctggcctgagaaggtaaagaagaggcatgtccagtatgctttgcagggtgtgtttgctcttttccatgcccatgcaacccagattggggtggagcaggaaggagctcttttctgttcccaagcctcagaactcttgagctgtggcttacttgctgtcttcaccaggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgtacttgacc

SEQ ID NO: 29211 - DNA, 2330 bp, Homo sapiens
actgtctgaggagagcctgaccttcagggagggacagcagggcctggcagagtctctgtaatgaggccgtgagtcacactggcctttgttcctcactcatctgtgctggccctcagccgaggggctgttggggaactctctgcaggcacagggcacctggtgactgggaagcttctgtttgtgtggacttcttgggaacagcgtcctggtgtgggccaggaggagaggactggagcaccccaggctctgacttcgtgctcctgggatcgtggtgcattgcctggccatggtggtcacccagctgaatctggagttttgctttcagggcaagaagctgcgaggcttcagctgtgagcttacccggtccccacatggggtcttgcctgaatctttcttcaccatcatgtgccaggtcgtggtgcccattctgctgtccggcttgtgcatgatgacagccggcctggtgatgaacaccattcaacactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctcgcagaagtgatggttcggctgacttggcaccaggccctggatcctgacaaccactgcatcccctaccttacagggctgggggacctgctcggtactggcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctctggggttgatacctgagcctgcaatagagccctgaaatcaagagcatggcttgagtgtgtgaatatgatgtgtgcacatgcttaatgagcgtgcaagtgtgcacacgtttgtggagaggagggtgttctggcctgagaaggtaaagaagaggcatgtccagtatgctttgcagggtgtgtttgctcttttccatgcccatgcaacccagattggggtggagcaggaaggagctcttttctgttcccaagcctcagaactcttgagctgtggcttacttgctgtcttcaccaggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgtacttg

SEQ ID NO: 29212 - DNA, 2090 bp, Homo sapiens
atggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggggtgctgatggtctgtatagtgattggtgctcgaaagctcggggtcaacccagacaacattgccacgcccattgcagccagcctgggagacctcatcacactgtccattctggctttggttagcagcttcttctacagacacaaagatagtcggtatctgacgccgctggtctgcctcagctttgcggctctgaccccagtgtgggtcctcattgccaagcagagcccacccatcgtgaagatcctgaagtttggctggttcccaatcatcctggccatggtcatcagcagtttcggaggactcatcttgagcaaaaccgtttctaaacagcagtacaaaggcatggcgatatttacccccgtcatatgtggtgttggtggcaatctggtggccattcagaccagccgaatctcaacctacctgcacatgtggagtgcacctggcgtcctgcccctccagatgaagaaattctggcccaacccgtgttctactttctgcacgtcagaaatcaattccatgtcagctcgagtcctgctcttgctggtggtcccaggccatctgattttcttctacatcatctacctggtggagggtcagtcagtcataaacagccagacctttgtggtgctctacctgctggcaggcctgatccaggtgacaatcctgctgtacctcgcagaagtgatggttcggctgacttggcaccaggccctggatcctgacaaccactgcatcccctaccttacagggctgggggacctgctcggtactggcctcctggcactctgctttttcactgactggctactgaagagcaaggcagagctgggtggcatctcagaactggcatctggacctccctaactgggccccgctggtcccatttgctcattagaatttcctctcacatcagtgggatacagaattcagtttctcccttgccaggtccttgggatggttgacccctgcctctgcagtagccttttgtgagtctgctaaggtagctctcacacacctcggctctggggttgatacctgagcctgcaatagagccctgaaatcaagagcatggcttgagtgtgtgaatatgatgtgtgcacatgcttaatgagcgtgcaagtgtgcacacgtttgtggagaggagggtgttctggcctgagaaggtaaagaagaggcatgtccagtatgctttgcagggtgtgtttgctcttttccatgcccatgcaacccagattggggtggagcaggaaggagctcttttctgttcccaagcctcagaactcttgagctgtggcttacttgctgtcttcaccaggttcaagctccgtgggccacactgctgctgtgccaagaaggtgtacagcctccccaggatggggcctcatacaacccttcatctgcactcaacatttaatcgtgtccttgctgtctttttattttcctttttgtttgttagcaaaaacctctatttagatttcaataatcagagaagtgtaaaataaaacagattatattgt

SEQ ID NO: 29213 - DNA, 526 bp, Homo sapiens
cccggtaagcgcggccctgttccgggcggggttggggcggaagggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtg

SEQ ID NO: 29214 - DNA, 544 bp, Homo sapiens
attgctcgggtgaccactggccttggcaagaacagtttgcatcaggagaagaggaggggagggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtg

SEQ ID NO: 29215 - DNA, 500 bp, Homo sapiens
ttaggcattagattctcataaggagcacacaacctagatcccctgcgtgcgcagttcacaatacggtttgagctcctatgaggatctgatgctgccggtgatctgacaggagagggaacctgatcaggcagtgatgctcgccgggagccgctcaccttctgctgtgtggcccagttcccaacgggggttggggacccctgctctaaaggatctcttggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgct

SEQ ID NO: 29216 - DNA, 726 bp, Homo sapiens
gggaggcgcgcgggagagggcgcccgggagtgggtgcgcgggaggcgagtgagccgggcgccgggccctgggggctcggcgggagggggagtcagggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgttgggcgtggtgtctcgagaggaagtggatgtcgccaaggtggagttgctgtgtgccagcagtgtcctcactgccttccttgcagcctttgccctgggtgagc

SEQ ID NO: 29217 - DNA, 588 bp, Homo sapiens
tctttcccgccgccgcctgggaggggacccgagggtttcaccatcttgcctaagctggtcttcaactcctgagctcaagcaatctgcttgcctcggcctcccaaagtgctgggattacaggcatgagccactgcatctggccagatagggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgcttctggactatttccaggccaacactggacaaattgatgacccccaggagcagcacagagtcatcagcagcaacctggccctcatccaggtgcaggccactgtcgtggggctcttggctgctgtggctgcgctgctgttgggcgtggtgtctcgaga

SEQ ID NO: 29218 - DNA, 530 bp, Homo sapiens
accgggatttgggggactcggtgggggaaaggcgcgcgggagatgagggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccacctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtg

SEQ ID NO: 29219 - DNA, 2598 bp, Homo sapiens
gaggggaaaagaagggagcccccgcccccacctcggggcgcagctccggacgcgtgtaaatacaactatcaactccgcagatccacttcatccaagcccagcttcgcagacctctggcgcccggcgggttcccagttcccccgcttcttccgaggagacagcggaggcgaggccaccgggctgtcaggctgaagctccgtggccgccgggtcctgcacgcagagaagaccccagcgccggcgcggctcagggctgggcccacgggactccggacgcgccgcgaaagcgttgcgctcccggaggcgtccgcagctgctggctgctcatttgccggtgaccggaggctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgcccaacatgtttgggaacctgcgctccacgttaatggccctcatgattggctcttacgcctcttctgccattacgttcccaggaatcaagctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagaggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatgagacaaatgaacagcaacaaaaggtggcagagacagttgggttctactcctccgtcttcggggccatgcagctgttgtgccttctcacctgccccctcattggctacatcatggactggcggatcaaggactgcgtggacgccccaactcagggcactgtcctcggagatgccagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgttcccatccaaccactttgggacgctgacaggcctgcagtccctcatcagtgctgtgttcgccttgcttcagcagccacttttcatggcgatggtgggacccctgaaaggagagcccttctgggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatagacttctcagaccaagggacctggatgacaggcaatcaaggcctgagcaaccaaaaggagtgccccatatggcttttctacctgtaacatgcacatagagccatggccgtagatttataaataccaagagaagttctatttttgtaaagactgcaaaaaggaggaaaaaaaaccttcaaaaacgccccctaagtcaacgctccattgactgaagacagtccctatcctagaggggttgagccttcttcctccttgggttggaggagaccagggtgcctcttatctccttctagcggtctgcctcctggtacctcttggggggatcggcaaacaggctacccctgaggtcccatgtgccatgagtgtgcacacatgcatgtgtctgtgtatgtgtgaatgtgagagagacacagccctcctttcagaaggaaaggggcctgaggtgccagctgtgtcctgggttaggggttgggggtcggccccttccagggccaggagggcaggttccctctctggtgctgctgcttgcaagtcttagaggaaataaaaagggaagtgagaga

SEQ ID NO: 29220 - DNA, 2358 bp, Homo sapiens
gtcagcagccgccagacttcctgccgaagtccgagccccctcccggggctggaggggggcaagcgggttccgaggtgcaaagcctggtgccccgagccctgcggagctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgcccaacatgtttgggaacctgcgctccacgttaatggccctcatgattggctcttacgcctcttctgccattacgttcccaggaatcaagctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagaggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatgagacaaatgaacagcaacaaaaggtggcagagacagttgggttctactcctccgtcttcggggccatgcagctgttgtgccttctcacctgccccctcattggctacatcatggactggcggatcaaggactgcgtggacgccccaactcagggcactgtcctcggagatgccagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgttcccatccaaccactttgggacgctgacaggcctgcagtccctcatcagtgctgtgttcgccttgcttcagcagccacttttcatggcgatggtgggacccctgaaaggagagcccttctgggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatagacttctcagaccaagggacctggatgacaggcaatcaaggcctgagcaaccaaaaggagtgccccatatggcttttctacctgtaacatgcacatagagccatggccgtagatttataaataccaagagaagttctatttttgtaaagactgcaaaaaggaggaaaaaaaaccttcaaaaacgccccctaagtcaacgctccattgactgaagacagtccctatcctagaggggttgagccttcttcctccttgggttggaggagaccagggtgcctcttatctccttctagcggtctgcctcctggtacctcttggggggatcggcaaacaggctacccctgaggtcccatgtgccatgagtgtgcacacatgcatgtgtctgtgtatgtgtgaatgtgagagagacacagccctcctttcagaaggaaaggggcctgaggtgccagctgtgtcctgggttaggggttgggggtcggccccttccagggccaggagggcaggttccctctctggtgctgctgcttgcaagtcttagaggaaataaaaagggaagtgaga

SEQ ID NO: 29221 - DNA, 690 bp, Homo sapiens
gcttcgcagacctctggcgcccggcgggttcccagttcccccgcttcttccgaggagacagcggaggcgaggccaccgggctgtcaggctgaagctccgtggccgccgggtcctgcacgcagagaagaccccagcgccggcgcggctcagggctgggcccacgggactccggacgcgccgcgaaagcgttgcgctcccggaggcgtccgcagctgctggctgctcatttgccggtgaccggagagctgcgcgtttgccagagttccagcggacctcctggagcgcttgaacccaaagccccgtttcacagatgagaataccgagtccccctggaagaagtgactggctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcag

SEQ ID NO: 29222 - DNA, 3081 bp, Homo sapiens
cagtgttttcttcttggggtcggaataaaagggctggaataaaagagggcagaaaaggcgccgggcgggcccgacacacgccggaggagccgggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagttggcctctacacctccatcttcggcgtgctccagctgctgtgcctgctgacggcccccgtcattggctacatcatggactggaggctgaaggagtgtgaagacgcctccgaggagcccgaggagaaagacgccaaccaaggcgagaagaaaaagaagaagcgggaccggcagatccagaagatcactaatgccatgcgggccttcgccttcaccaacctgctgctcgtgggctttggggtgacctgcctcattcccaacctgcctctccagatcctctccttcatcctgcacacaatcgtgcgaggattcatccactccgctgtcgggggcctgtacgctgccgtgtacccctccacccagttcggcagcctcacgggactgcagtctctgatcagcgcgctcttcgcccttctgcagcagccgctgtttctggccatgatgggtcctctccagggagaccctctgtgggtgaacgtggggctgctccttctcagcctgctgggcttctgcctcccgctctacctgatctgctaccggcgccagctggagcggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtctccgtgccagcgttcacgctccctcccggggccctgcctcggagctctgtggtggaaggacgggagagggccccggacacgcgcgttttctcctgccgaacgcaggggctgccctgactttgctctgccgccccccggggacccggggcctggggtctctgtggtgcctgcagcaggagccaggaacgcccggcaggcaggcgctctcccgccagtgtctggattctgcctcttgccaaagcagagggggctgccatcccctgcctgccacctgcccctcggctgcatgcccacagccgtacctgcctgaggacaaaggcttgcactgtctcgcccgcgcctggcccccaccccctccccggccagcctgaggctgcctgaggaaggaaggacccgcttcctgttgtcggtgctaattcctttgtaattccagccccctgtcgcctgtccagggcctgcccacccgttggaggccggtggagaagccccacctggcttatgccctggagagggtttagcgggctgggtggacccctcgcctcctccccgagggccaatgccgcggacacgttttcactgtcaccctcgttctgtctgccacctgaagggaatttgaggaccgccgccagggcaccccgtacatacacacagctgcttttgtggaggtggacgaaaggctgtggccggcagacgtggaggtccaggccggggtggggacgtgggtgggtccgaggtgtgtgtggggtcggggtgggctctaggagttagcccttatccccactgaccaggcgggagccgccaggcctgcagctgggccagtgcccaggagccatcctggcgtggggccaggagcttgtccaaggccacaggcccacagcaccccctgccggcgggctccgtggggccctggagctgatgacgggggaggcccgtccgcctggcccaccaacccgcccaccttgactgcccccagaagtgtgtcttgagacctcctgggcgtgcttagaggggtgagttgtgtttggatttttagttattttctcttcagttttattagacttcttttttataaagcaataaatccattttcctccgggtaagggatgccccttctggcatatcagttaata

SEQ ID NO: 29223 - DNA, 3011 bp, Homo sapiens
agaaaaggcgccgggcgggcccgacacacgccggaggagccgggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcagcgcctgcttcgcggtttcctgcttgctgattgcgtacggagcaagtaaaccaaacgctctctccgtgctcatcttcatcgccctggctctgaatggctttggtgggatgtgtatgaccttcacctcattaacactgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagcttcctccacagttggcctctacacctccatcttcggcgtgctccagctgctgtgcctgctgacggcccccgtcattggctacatcatggactggaggctgaaggagtgtgaagacgcctccgaggagcccgaggagaaagacgccaaccaaggcgagaagaaaaagaagaagcgggaccggcagatccagaagatcactaatgccatgcgggccttcgccttcaccaacctgctgctcgtgggctttggggtgacctgcctcattcccaacctgcctctccagatcctctccttcatcctgcacacaatcgtgcgaggattcatccactccgctgtcgggggcctgtacgctgccgtgtacccctccacccagttcggcagcctcacgggactgcagtctctgatcagcgcgctcttcgcccttctgcagcagccgctgtttctggccatgatgggtcctctccagggagaccctctgtgggtgaacgtggggctgctccttctcagcctgctgggcttctgcctcccgctctacctgatctgctaccggcgccagctggagcggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtctccgtgccagcgttcacgctccctcccggggccctgcctcggagctctgtggtggaaggacgggagagggccccggacacgcgcgttttctcctgccgaacgcaggggctgccctgactttgctctgccgccccccggggacccggggcctggggtctctgtggtgcctgcagcaggagccaggaacgcccggcaggcaggcgctctcccgccagtgtctggattctgcctcttgccaaagcagagggggctgccatcccctgcctgccacctgcccctcggctgcatgcccacagccgtacctgcctgaggacaaaggcttgcactgtctcgcccgcgcctggcccccaccccctccccggccagcctgaggctgcctgaggaaggaaggacccgcttcctgttgtcggtgctaattcctttgtaattccagccccctgtcgcctgtccagggcctgcccacccgttggaggccggtggagaagccccacctggcttatgccctggagagggtttagcgggctgggtggacccctcgcctcctccccgagggccaatgccgcggacacgttttcactgtcaccctcgttctgtctgccacctgaagggaatttgaggaccgccgccagggcaccccgtacatacacacagctgcttttgtggaggtggacgaaaggctgtggccggcagacgtggaggtccaggccggggtggggacgtgggtgggtccgaggtgtgtgtggggtcggggtgggctctaggagttagcccttatccccactgaccaggcgggagccgccaggcctgcagctgggccagtgcccaggagccatcctggcgtggggccaggagcttgtccaaggccacaggcccacagcaccccctgccggcgggctccgtggggccctggagctgatgacgggggaggcccgtccgcctggcccaccaacccgcccaccttgactgcccccagaagtgtgtcttgagacctcctgggcgtgcttagaggggtgagttgtgtttggatttttagttattttctcttcagttttattagacttcttttttataaagcaataaatccattttcctccgggt

SEQ ID NO: 29224 - DNA, 1490 bp, Homo sapiens
attatgcgcagctgagaccggtggaggcagggaagctggggacggagtgagcgagagggggaatgtggggagtgacccagatgtcaggatgacctacgggagtccacaggcaaatgcaagcccatccgatgctgtggcgctggaccatggggaggtcagccgaaggcaacagcaggagctgcccaacatgttcggcgaccttcggtccacgtttattgccttgatgattgggtcctacgcctcctcggcagtcacctttccaggaatcaagctcatctatgatgctggtgtctccttcatcgtcgtcctcgtggtctgggccggctgctccgggctggttttcctcaactgcttctttaactggccccttgagcccttcccggggccggaggacatggactactcggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgccgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacagttggcctctacacctccatcttcggcgtgctccagctgctgtgcctgctgacggcccccgtcattggctacatcatggactggaggctgaaggagtgtgaagacgcctccgaggagcccgaggagaaagacgccaaccaaggcgagaagaaaaagaagaagcgggaccggcagatccagaagatcactaatgccatgcgggccttcgccttcaccaacctgctgctcgtgggctttggggtgacctgcctcattcccaacctgcctctccagatcctctccttcatcctgcacacaatcgtgcgaggattcatccactccgctgtcgggggcctgtacgctgccgtgtacccctccacccagttcggcagcctcacgggactgcagtctctgatcagcgcgctcttcgcccttctgcagcagccgctgtttctggccatgatgggtcctctccagggagaccctctgtgggtgaacgtggggctgctccttctcagcctgctgggcttctgcctcccgctctacctgatctgctaccggcgccagctggagcggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtct

SEQ ID NO: 29225 - DNA, 2407 bp, Homo sapiens
ttttcacttgttaattattttctgttctcatgattatgtgtaatcttttatgcagagatatcacattagatatacttttccccttatattattacattataagcatttccatatattagtactcatggttactgttttaaatagctgcctattatgctgtttgttgatgtctcagcatgactttgtttatatgagaggtattaagcttatgctgtaaacacctttattaatctgagattttgtatgctgttttgttagaggaaacattctattaatggtggcatatttcaagtaaaagcatgtgctttttatttttaaatcgcttatggcaaaaattcattttcagttcaataaagtatgtgtttgtaagctttgtcatctgccccttgactggtagatgtgcaggctaaggagttttaagtgtttggttttgcttttggtagttgtgtgtgtgtatgtgtgtgtgtgtgtgtgcgtttcttttcagaaggggcgggtaatgtcttctgttggaacatgcactccaccctctttgataaggcttgtggtaagatttgcatcactacccatgacagtcatcctcatagcattaagcacacagctcttagctcccataatgatgtgtggagggtggagtgtattgcagccatattcacctttcatttgtgtgtttgatgtggcatttatattaagtaggagtaattttttttctgatttttttttcttgtgtcaccagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatgctgaagaaaaggtgactggtctcatgagccctgaagaatgaactcagaggaggttgtttacatgaggttctcccactcaccagctgttgagagtctgcgattatgaagagcaggatcttattacttcaatgaaagcatgtaacaagtttctcaaaccaccaacagccaagtggatttggtacagtgcggctgtctaataaataatcaaaagcatttgatag

SEQ ID NO: 29226 - DNA, 10511 bp, Homo sapiens
agcagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttgaacctagccgacggttatggaaacccattgacattccaaaacaatatatacacataactatgtatttgtgtgtgtgggtgtgtgtatatatgtatatgtatgtgtgtatatatgtatatgtatatacacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgggaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaacattgtgtttagaaattataatctatgtgtaaccatgtcatttgagttgcaaattaattgccaggctgttttccttaagtaaattcatgtgccgtgtagaaatatgcagatatgcattacacaggcacacacagagagatatttaatatgtggaatatcactctttcatgagctttattccttgattaatttgataaagcctcacagaggattttaagcaatatttaaatgtgttgaggttatgtttggatattcctgctgcctcttttcattcatttcaagtcattcttcagctagctatgggctgccttattgctattcgctcactgcttccatcttctgcccaagtgagaagaatagatgaagaacagaaatttctctgtgaaatgtggatacccgaataatttcataaatcattgattctatgtggtggtttttgtcttcttctgtggtgaatcttcaaaactgtattcaggactcatatttctagagttttaattggggtcctctattgtcaattgtagtagtgaccagagtatcgtggtttttgccatcagataattaaggctctggtgcataatttagactttctaagctcctgcctgaagaataaggtcttccataatatggaagagaaaagttatatttcagtgtaaatccaagagacccatcttctatgagaggcttaccagtgcattagtaataaaacattagcaatttagctagagcactgagattgtataatccttgcatggatgagcagagctcaaagccagttgttcctttaaagcatttaatgcaatggctaatgtttaggattaaagtttttattttatcctataagataattaagtcctaagtcactacaacttaagtagcttaactgtatgttggtacccaaactttttctataatggttaaggaggaggcacttactgagtttattttaaagttatgctagaaatgtttttcttttgtagagatgctctctctctctctctctttttttttttttttttttttttttttccgtgagggcattaggctgctgattgtaagttatttccaataccactgatcttggtatctgccaagggcttccttgccttccctgggcagttttaggatttcaccctagtagggggtatgaggcactgacccctttattctggacccaaactgctttagagcagagttaatacctctccctccctcttcaaaacagctacaggaactgcaggcaccacatatgtgtgaggccacatcactgcccctgaggcttcaactatttccaccatgcactattactagctactaacagccattttaagagatctcctagcctgcaaggtagaattctgggatcagttccaaaaccagaactgccagtaatggtgacttgaatattttatttgatttttggtcagtaaccttgtcatttaaattggactttccaatagccttaacatggcctctgagaagtttcctccagaaaggtctttaagctttcgcttttcaataagtaagttctttactgcttttctactgctactttaaaaaaaaaacaacaacaacaaataaaactctcagagtctggaggcttatcagtgcacctgccacagttaatttctgtattcttttcatacattccatctgacacatacgagtgcactataatggcttgcctagaactggtaagaagtggtctgtgaatgtatattgaaaaaatgtgggttcataagtaaaagcgtaacgcagatatttgtgtattctgtattcacagcgtaggctgccttttgctttaaatgcatattcatgtatctttgtgtgctaagaatgcatgttagcccttttgaaaagtaggcactattcatacacagtagcttcttggaattaactcatctttgttaacttagtggcacatagtccaaatttttaaaaagcaagacccttgaatatgccaagagaaaatctaaagctagcaaacttaaaaaacaaaacaaaaattacacgtcgtgtacagttatgaatttagaatagcacactttttccattcagatttcatacatttgagccaaattcttatactccatgttttaattttaaaaggataattttaatccaagatttaaatctttgaaaatatctttcttatagaaaactttaatgcagtttttaaacttactgatttctgtggaaaacctttcttttctatagaaatactgtagtgccctttcttcccatcttgattttgtacatgtaaagacaaatgatgattcagtttcaatattgcatgaacaattgccactttgtaaattatatggacagaatgtgttctaaggaaattcgttagtaaatttgtgaaaaacatgtgagattgttcgagacctattaggctattcttcagttttgatgctcagttttacaacttaaatgattttctccaggacacggagctcagaataataaagcttttattaatggtctagtgaagatctagttgaacatggaaacattgtaatttacaaatgtctcagaaatttctcacttttatttgctaagacctgaatttaatatttgatattcaaaaacaagttattttgaagagacaatgggtctctttgagcttaagaaagctatggactatctttccttcaaatgcacatcacatgtctgtgaacactcaaaatgctcatagaatttcagggccctcagacggccagcttccacccctgtaccccctcaggggctaatgaacccaagtcaaaaggctgctctaaagttgttctgataatgtgttttgaaatgaggaagtgattaggcctccactagagatacttttgagatgatgcttaccaccttctgacctggaatcatttttataacttaaagactttatgtaatttagtagcaggttagggaatagaaaccacactaatctgaaggaataacaagatgatcaacactgaatcttcatgacagtaagattttctttccttggaggtatgagggtgtgtatgtgtgtgtgtgtgtgtgtgtgtttgtgtgtgtgtgtgtgtgtcctggcggttatttgggggcaaggtaccagattatttgcagtgagccaaaaaaaaaaaaatatccaagaagaaataaatagggaatccttgtaattaatccatctaccaaaacacttgattctttttattgtagctcagctatgacattatgacattatgtggcttagtgttatcagtatactactgtcttaaaatatatttgtcaacatgtccagttccaacaacagttgaagatgatgataaattagcaaactcaagggtagtccatagttggcaaaaaataaatttggtagaaagttggaggagcagatgctgaaggtagaaatgcaaaagatgttttttcttcctgcataaatcacggaggtgtgttctgttttagtgttttccagtcacccactagagcagcttcagattcctctgccaatagaactccacccccagtcccttacctactctatcttctttagggaagcatgtggatttcttcacatctgcaccttactattaggtaagggtgctgcatctacatggaaggctccctgggcccttgaaaaagcaggcagaaactcatcaaggggtttgaagttcttgtgaaatttgatcccagtggctcatgacttatagtcaggcatcaaaccatttcctactttttcaggctgaagaaagtggaaatataactggctggtgaagaaaggagaaaagtcagccccctaccccaccccacactcctagaaaagtttgggggttttttttgtttgtttttggtgtttttttgagacggagtctcgctctatcgccagcttagagtgcagtggctcaatcttagctcactgcaacctccacctcccaggttcaagtgattctcctgcatcagcctcctgagtagctgggaccacaggcatgtgccaccacacccagctaatttttgtatttttagtagagacggggtttcaccacgttggccaggccaatctcgaactcctgacctcaggtgatccacccgcctcagcctcccaaagtgctgggattacaggcatgagccaccgcgcccggcctagaagagttttaatgaaccttccacagtagtaaatgcagagaccactggtggaaattcccatgttggatagaaaagggcgtaagtccagtctaagtatctaaatgtgatatgcccttttgtcacagaagtgtaagacttaaagggaatattctgaccttcgtgtatgaatctgatccacccatcctgtcagctaggattataatttgaactgtcgtttcaggagcatgtgttaaatcatatgagtaaaaaaaaagtagacattgaaaagaagacttgggaataattgggcagatagaatgggttccatggatcattctagttgccactagaaaatgtgagctccttcttcatttaccatgttgataatccggtggtgactttttttttttttttgtaaattgtattagataccccacaggaatgtgacaataataggatagctttgggggctggtgatttgaaacagggactattaagtagattttcccccatcctctaggttcctgtagtctgtgctcagaacttggtttttggcccctattgtttttgcctattttgattttcagagatgatcacatggggacagttaacttttcttctgctgtgttgccttaatgctactagattgtgttgtgttgttggagttttctgacttcttccctataaaaagatactgagagctccataatgaaagaagttgttatactttctcagaatattctggaccactgaatgcacttctaatagagctttaatctaaagaagttagttcagtggttattaactgattttattacaggagaaaaaaactttaacaaaaaggcagggagaaaagtgtgaagggcatcaagcaaaatgacaggggcttcaaaaaacaaccaaagacaaaaccctatcttctgaagaccaaaggtccaactttacttactggctggcacagcctttctgaactccttgagtttagaatagagctcctagaataataaggcggccaaatttaaagatcagtcaatacagtagggacctgctattgatctctcaggcactgagtcttcacatccagtgtcaagcccagcccagcatatggggtgatatgagcagaaaacacacatcggtgtgtcttgatttctcgcagctgtgtaatgtggcatgagaagtatgttttggtgccacatatttctcaatctgatgcctttttgtctttttttttttttgccatttgcatcctatttcatagtgccaaaatgaatttttgtatcttgtcttgtctttgtccattataaactggaggatcacagttaagccttccatgaattcatagtttggaatcatttaccttaccattattttggatttttttcttattacagtgtcactacactgtattcatgtgggggaacaaacatgtaggtgcttgaacatgccccacagacacagttgtagccctagtatttgtgacggtcattattgacacagtgcagactttgcagatggagcattatgctctcagaggactttaaaaatatgtatattaagcaattaactttctggagttggagttatcaaatcttgctgggaaattaacttccaagagctctgaattggatggaattccatctggcttcagagaacaatcagcctatatgaaacggagctttgaaatgtttttcttgtgcagaaatacgaactagaaagaaaagtgctgatctaatgctaagttttctctgtgtactgactcagttgccagaattataatgaaaactgtattttagtctaacaaatgtatagaattttttatgtaataaataaaattttataggaaagaa

SEQ ID NO: 29227 - DNA, 9640 bp, Homo sapiens
agcagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatgattaagtaatgctgggaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaacattgtgtttagaaattataatctatgtgtaaccatgtcatttgagttgcaaattaattgccaggctgttttccttaagtaaattcatgtgccgtgtagaaatatgcagatatgcattacacaggcacacacagagagatatttaatatgtggaatatcactctttcatgagctttattccttgattaatttgataaagcctcacagaggattttaagcaatatttaaatgtgttgaggttatgtttggatattcctgctgcctcttttcattcatttcaagtcattcttcagctagctatgggctgccttattgctattcgctcactgcttccatcttctgcccaagtgagaagaatagatgaagaacagaaatttctctgtgaaatgtggatacccgaataatttcataaatcattgattctatgtggtggtttttgtcttcttctgtggtgaatcttcaaaactgtattcaggactcatatttctagagttttaattggggtcctctattgtcaattgtagtagtgaccagagtatcgtggtttttgccatcagataattaaggctctggtgcataatttagactttctaagctcctgcctgaagaataaggtcttccataatatggaagagaaaagttatatttcagtgtaaatccaagagacccatcttctatgagaggcttaccagtgcattagtaataaaacattagcaatttagctagagcactgagattgtataatccttgcatggatgagcagagctcaaagccagttgttcctttaaagcatttaatgcaatggctaatgtttaggattaaagtttttattttatcctataagataattaagtcctaagtcactacaacttaagtagcttaactgtatgttggtacccaaactttttctataatggttaaggaggaggcacttactgagtttattttaaagttatgctagaaatgtttttcttttgtagagatgctctctctctctctctctttttttttttttttttttttttttttccgtgagggcattaggctgctgattgtaagttatttccaataccactgatcttggtatctgccaagggcttccttgccttccctgggcagttttaggatttcaccctagtagggggtatgaggcactgacccctttattctggacccaaactgctttagagcagagttaatacctctccctccctcttcaaaacagctacaggaactgcaggcaccacatatgtgtgaggccacatcactgcccctgaggcttcaactatttccaccatgcactattactagctactaacagccattttaagagatctcctagcctgcaaggtagaattctgggatcagttccaaaaccagaactgccagtaatggtgacttgaatattttatttgatttttggtcagtaaccttgtcatttaaattggactttccaatagccttaacatggcctctgagaagtttcctccagaaaggtctttaagctttcgcttttcaataagtaagttctttactgcttttctactgctactttaaaaaaaaaacaacaacaacaaataaaactctcagagtctggaggcttatcagtgcacctgccacagttaatttctgtattcttttcatacattccatctgacacatacgagtgcactataatggcttgcctagaactggtaagaagtggtctgtgaatgtatattgaaaaaatgtgggttcataagtaaaagcgtaacgcagatatttgtgtattctgtattcacagcgtaggctgccttttgctttaaatgcatattcatgtatctttgtgtgctaagaatgcatgttagcccttttgaaaagtaggcactattcatacacagtagcttcttggaattaactcatctttgttaacttagtggcacatagtccaaatttttaaaaagcaagacccttgaatatgccaagagaaaatctaaagctagcaaacttaaaaaacaaaacaaaaattacacgtcgtgtacagttatgaatttagaatagcacactttttccattcagatttcatacatttgagccaaattcttatactccatgttttaattttaaaaggataattttaatccaagatttaaatctttgaaaatatctttcttatagaaaactttaatgcagtttttaaacttactgatttctgtggaaaacctttcttttctatagaaatactgtagtgccctttcttcccatcttgattttgtacatgtaaagacaaatgatgattcagtttcaatattgcatgaacaattgccactttgtaaattatatggacagaatgtgttctaaggaaattcgttagtaaatttgtgaaaaacatgtgagattgttcgagacctattaggctattcttcagttttgatgctcagttttacaacttaaatgattttctccaggacacggagctcagaataataaagcttttattaatggtctagtgaagatctagttgaacatggaaacattgtaatttacaaatgtctcagaaatttctcacttttatttgctaagacctgaatttaatatttgatattcaaaaacaagttattttgaagagacaatgggtctctttgagcttaagaaagctatggactatctttccttcaaatgcacatcacatgtctgtgaacactcaaaatgctcatagaatttcagggccctcagacggccagcttccacccctgtaccccctcaggggctaatgaacccaagtcaaaaggctgctctaaagttgttctgataatgtgttttgaaatgaggaagtgattaggcctccactagagatacttttgagatgatgcttaccaccttctgacctggaatcatttttataacttaaagactttatgtaatttagtagcaggttagggaatagaaaccacactaatctgaaggaataacaagatgatcaacactgaatcttcatgacagtaagattttctttccttggaggtatgagggtgtgtatgtgtgtgtgtgtgtgtgtgtgtttgtgtgtgtgtgtgtgtgtcctggcggttatttgggggcaaggtaccagattatttgcagtgagccaaaaaaaaaaaaatatccaagaagaaataaatagggaatccttgtaattaatccatctaccaaaacacttgattctttttattgtagctcagctatgacattatgacattatgtggcttagtgttatcagtatactactgtcttaaaatatatttgtcaacatgtccagttccaacaacagttgaagatgatgataaattagcaaactcaagggtagtccatagttggcaaaaaataaatttggtagaaagttggaggagcagatgctgaaggtagaaatgcaaaagatgttttttcttcctgcataaatcacggaggtgtgttctgttttagtgttttccagtcacccactagagcagcttcagattcctctgccaatagaactccacccccagtcccttacctactctatcttctttagggaagcatgtggatttcttcacatctgcaccttactattaggtaagggtgctgcatctacatggaaggctccctgggcccttgaaaaagcaggcagaaactcatcaaggggtttgaagttcttgtgaaatttgatcccagtggctcatgacttatagtcaggcatcaaaccatttcctactttttcaggctgaagaaagtggaaatataactggctggtgaagaaaggagaaaagtcagccccctaccccaccccacactcctagaaaagtttgggggttttttttgtttgtttttggtgtttttttgagacggagtctcgctctatcgccagcttagagtgcagtggctcaatcttagctcactgcaacctccacctcccaggttcaagtgattctcctgcatcagcctcctgagtagctgggaccacaggcatgtgccaccacacccagctaatttttgtatttttagtagagacggggtttcaccacgttggccaggccaatctcgaactcctgacctcaggtgatccacccgcctcagcctcccaaagtgctgggattacaggcatgagccaccgcgcccggcctagaagagttttaatgaaccttccacagtagtaaatgcagagaccactggtggaaattcccatgttggatagaaaagggcgtaagtccagtctaagtatctaaatgtgatatgcccttttgtcacagaagtgtaagacttaaagggaatattctgaccttcgtgtatgaatctgatccacccatcctgtcagctaggattataatttgaactgtcgtttcaggagcatgtgttaaatcatatgagtaaaaaaaaagtagacattgaaaagaagacttgggaataattgggcagatagaatgggttccatggatcattctagttgccactagaaaatgtgagctccttcttcatttaccatgttgataatccggtggtgactttttttttttttttgtaaattgtattagataccccacaggaatgtgacaataataggatagctttgggggctggtgatttgaaacagggactattaagtagattttcccccatcctctaggttcctgtagtctgtgctcagaacttggtttttggcccctattgtttttgcctattttgattttcagagatgatcacatggggacagttaacttttcttctgctgtgttgccttaatgctactagattgtgttgtgttgttggagttttctgacttcttccctataaaaagatactgagagctccataatgaaagaagttgttatactttctcagaatattctggaccactgaatgcacttctaatagagctttaatctaaagaagttagttcagtggttattaactgattttattacaggagaaaaaaactttaacaaaaaggcagggagaaaagtgtgaagggcatcaagcaaaatgacaggggcttcaaaaaacaaccaaagacaaaaccctatcttctgaagaccaaaggtccaactttacttactggctggcacagcctttctgaactccttgagtttagaatagagctcctagaataataaggcggccaaatttaaagatcagtcaatacagtagggacctgctattgatctctcaggcactgagtcttcacatccagtgtcaagcccagcccagcatatggggtgatatgagcagaaaacacacatcggtgtgtcttgatttctcgcagctgtgtaatgtggcatgagaagtatgttttggtgccacatatttctcaatctgatgcctttttgtctttttttttttttgccatttgcatcctatttcatagtgccaaaatgaatttttgtatcttgtcttgtctttgtccattataaactggaggatcacagttaagccttccatgaattcatagtttggaatcatttaccttaccattattttggatttttttcttattacagtgtcactacactgtattcatgtgggggaacaaacatgtaggtgcttgaacatgccccacagacacagttgtagccctagtatttgtgacggtcattattgacacagtgcagactttgcagatggagcattatgctctcagaggactttaaaaatatgtatattaagcaattaactttctggagttggagttatcaaatcttgctgggaaattaacttccaagagctctgaattggatggaattccatctggcttcagagaacaatcagcctatatgaaacggagctttgaaatgtttttcttgtgcagaaatacgaactagaaagaaaagtgctgatctaatgctaagttttctctgtgtactgactcagttgccagaattataatgaaaactgtattttagtctaacaaatgtatagaattttttatgtaataaataaaattttataggaaagaa

SEQ ID NO: 29228 - DNA, 3088 bp, Homo sapiens
agcagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatgctgaagaaaaggtgactggtctcatgagccctgaagaatgaactcagaggaggttgtttacatgaggttctcccactcaccagctgttgagagtctgcgattatgaagagcaggatcttattacttcaatgaaagcatgtaacaagtttctcaaaccaccaacagccaagtggatttggtacagtgcggctgtctaataaataatcaaaagcatttgatagaaatctgtcttgcagcactgtcttcacatttaatgttgctttctcttctagtctcgggtatgtttaaatgattcccttttctcactctagcgccaatactggcctgaaggctagatccccagcgaaattcttgttcaggctgggtctgtcgactttgactctgctatttatagagccaatgtgggttaataactactatttattgagtgcccgttccatgccaagcattaggctgggtgctttacataagtttaatcctcacaatagccctgtaaggttgcacctattatctccactttgaccacgaagaaacggagactcagagagtttgtatcctatgtgtaagatcacacagttgtcagagtcaggattcaaatctagttctaactccaaagctctccacactaacattgttttgcttattattgctccaaagataattaccccaacaccttatcaatgctatacttcctctcataatggcagtgtaggtatgtgggaagtgtctgagatggaggaccagggagtctttagaggcgcaaaagaatcacagaattatcttctaaaaaaaaacacaatattctttgagatcaggagttgataaaatatggcccccagctatttttgtaaataaaggtttattgggaacacagccacacccaatccttca

SEQ ID NO: 29229 - DNA, 10433 bp, Homo sapiens
agcagctgctgcagcaggagcagagcaggagacgcgtagccgccgtcgccgccgccgggggatgtggccggcgcctgcctctagccgcgccgcctcttgagtaccagccgccgctgcagccgccgccgccgcctagccgtgcggtgccaggccgcgccctccccgggcgcccgccggctcgcatgccgaggggctccggggcgtagctgcgcgcccggcgccgcctccgggctccttcggccccgccatgggctgctgcagctccgcctcctccgccgcgcagagctccaaacgagaatggaagccgctggaggaccgtagctgcacagacataccatggctgctgctcttcatcctcttctgcattgggatgggatttatttgtggcttttcaatagcaacaggtgcagcagcaagactagtgtcaggatacgacagctatggaaatatctgtgggcagaaaaatacaaagttggaagcaataccaaacagtggcatggaccacacccagcggaagtatgtattctttttggatccatgcaacctggacttgataaaccggaagattaagtctgtagcactgtgtgtagcagcgtgtccaaggcaagaactgaaaactctgagtgatgttcagaagtttgcagagataaatggttcagccctatgtagctacaacctaaagccttctgaatacactacatctccaaaatcttctgttctctgccccaaactaccagttccagcgagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagttctatccatgattttgatggtgataatcaggtatatatcaagagtacttgtgtggatcttaacgattctggtcatactcggttcacttggaggcacaggtgtactatggtggctgtatgcaaagcaaagaaggtctcccaaagaaactgttactcctgagcagcttcagatagctgaagacaatcttcgggccctcctcatttatgccatttcagctacagtgttcacagtgatcttattcctgataatgttggttatgcgcaaacgtgttgctcttaccatcgccttgttccacgtagctggcaaggtcttcattcacttgccactgctagtcttccaacccttctggactttctttgctcttgtcttgttttgggtgtactggatcatgacacttctttttcttggcactaccggcagtcctgttcagaatgagcaaggctttgtggagttcaaaatttctgggcctctgcagtacatgtggtggtaccatgtggtgggcctgatttggatcagtgaatttattctagcatgtcagcagatgacagtggcaggagctgtggtaacatactattttactagggataaaaggaatttgccatttacacctattttggcatcagtaaatcgccttattcgttaccacctaggtacggtggcaaaaggatctttcattatcacattagtcaaaattccgcgaatgatccttatgtatattcacagtcagctcaaaggaaaggaaaatgcttgtgcacgatgtgtgctgaaatcttgcatttgttgcctttggtgtcttgaaaagtgcctaaattatttaaatcagaatgcatacacagccacagctatcaacagcaccaacttctgcacctcagcaaaggatgcctttgtcattctggtggagaatgctttgcgagtggctaccatcaacacagtaggagattttatgttattccttggcaaggtgctgatagtctgcagcacaggtttagctgggattatgctgctcaactaccagcaggactacacagtatgggtgctgcctctgatcatcgtctgcctctttgctttcctagtcgctcattgcttcctgtctatttatgaaatggtagtggatgtattattcttgtgttttgccattgatacaaaatacaatgatgggagccctggcagagaattctatatggataaagtgctgatggagtttgtggaaaacagtaggaaagcaatgaaagaagctggtaagggaggcgtcgctgattccagagagctaaagccgatggcttcgggagcaagttctgcttgaacctagccgacggttatggaaacccattgacattccaaaacaatatatacacacacacataaatcagccaaaatcagagaaaaggaacagggatttaataccttttttatgcttatttttgtcaaacatgtactcctttcatacgggtggcttttacaaggcaacttccgtcatttaatgttttcaactgtaattgtcttaatggaaatgttaaaattcatatctgattaacatttttaataacttagaggagattttaactttatttaaaaataggtaaaattattgtacctaattatgtctaaagtttattcaggggtaatttccctgatgtctgtataaaatcaagatcttattttactgatgcataagtcctagtgggtcaagactaggcatatgctttcagataaataaggaattactccaatcagttttccccaatcaaagaagccatgtcattttacttttagaaacatacaattgggcccaatatgggaattttcataatagttcatacatttgtcagccaacattaaaaggtaaccaactcctcaggtatttgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtgcctgatttgaaaggaagctggggcacccagcgagtttagcctttaagtttctgtgtattgatttgcagattaagtaatgctgggaggaataaagaagggacagaaacatggaacataaagcattgaaaattccggtgcttgggcttcggcttcagagtaacgtcagtggcttagggttaaacggccattttattcaaatgcttgctatacaatctgaaaacacactggcaggtgctcctctccttggcaattcattgagtatccagagttctacgatgtttaactgaagaattggctaatgttttgatcctccagtgtgactgttgtttttgtttgggggtgggtttggggttttttgcttttttattcctgaagcttaccagatatgaatggctaatactccattgttctgcttgttgtaatggtgaatgctttaagaaaaaaaagtgtaatttgctaagaataattcatgatctgtttatgcgataactcctttttgttacaatttttttaaaaaaagctatttttgttaatgtaaagtaaatatttcagagcaaattttttaaacttattgcactaaatacaggctctgtacaaaaaaaaaaaaaaaaaaaaagcctcagcattttatcattccatggaaggagaatcttttgaaagaaagcattgcctcctaccagaactagacagtgaattagatcggtattatggaaatgcatacaagtaatgtcactagggcttaataagcagccgtttgctaatgtgcttcctttcaaagggttggacctttaaattgctgcaaaaggtaaattgtatttttttttaagtattggtgttctttactctagctaggctaaaatttgctaaatgccttggtttcttttaaaagttcatgtaatatttctgatttttcagaatatttgcaataagagtctggattttaaaaaacacatgcatacacacaattaagagctcatgtcttagcaagatctgggaaaccaacattgcgagagtagctattttgaaagaataattctccagaagttaacatctaatatctagtatcaccaaacagtatcgctgttctcttttattcatttgaaatgaatataattatataactaacaattgtccaaatagatgagagagcaaatcatgtgagaaaattcagaataccatctgtttcatagccgcacagattttggactttcacaaacattgggaactaaatttagaattggcaaaagtctagaagatgggtatcaaaacagaagacattccaggagctagcaattttaagaggtgtccctccaaagtgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgttttactaacattgtgtttagaaattataatctatgtgtaaccatgtcatttgagttgcaaattaattgccaggctgttttccttaagtaaattcatgtgccgtgtagaaatatgcagatatgcattacacaggcacacacagagagatatttaatatgtggaatatcactctttcatgagctttattccttgattaatttgataaagcctcacagaggattttaagcaatatttaaatgtgttgaggttatgtttggatattcctgctgcctcttttcattcatttcaagtcattcttcagctagctatgggctgccttattgctattcgctcactgcttccatcttctgcccaagtgagaagaatagatgaagaacagaaatttctctgtgaaatgtggatacccgaataatttcataaatcattgattctatgtggtggtttttgtcttcttctgtggtgaatcttcaaaactgtattcaggactcatatttctagagttttaattggggtcctctattgtcaattgtagtagtgaccagagtatcgtggtttttgccatcagataattaaggctctggtgcataatttagactttctaagctcctgcctgaagaataaggtcttccataatatggaagagaaaagttatatttcagtgtaaatccaagagacccatcttctatgagaggcttaccagtgcattagtaataaaacattagcaatttagctagagcactgagattgtataatccttgcatggatgagcagagctcaaagccagttgttcctttaaagcatttaatgcaatggctaatgtttaggattaaagtttttattttatcctataagataattaagtcctaagtcactacaacttaagtagcttaactgtatgttggtacccaaactttttctataatggttaaggaggaggcacttactgagtttattttaaagttatgctagaaatgtttttcttttgtagagatgctctctctctctctctctttttttttttttttttttttttttttccgtgagggcattaggctgctgattgtaagttatttccaataccactgatcttggtatctgccaagggcttccttgccttccctgggcagttttaggatttcaccctagtagggggtatgaggcactgacccctttattctggacccaaactgctttagagcagagttaatacctctccctccctcttcaaaacagctacaggaactgcaggcaccacatatgtgtgaggccacatcactgcccctgaggcttcaactatttccaccatgcactattactagctactaacagccattttaagagatctcctagcctgcaaggtagaattctgggatcagttccaaaaccagaactgccagtaatggtgacttgaatattttatttgatttttggtcagtaaccttgtcatttaaattggactttccaatagccttaacatggcctctgagaagtttcctccagaaaggtctttaagctttcgcttttcaataagtaagttctttactgcttttctactgctactttaaaaaaaaaacaacaacaacaaataaaactctcagagtctggaggcttatcagtgcacctgccacagttaatttctgtattcttttcatacattccatctgacacatacgagtgcactataatggcttgcctagaactggtaagaagtggtctgtgaatgtatattgaaaaaatgtgggttcataagtaaaagcgtaacgcagatatttgtgtattctgtattcacagcgtaggctgccttttgctttaaatgcatattcatgtatctttgtgtgctaagaatgcatgttagcccttttgaaaagtaggcactattcatacacagtagcttcttggaattaactcatctttgttaacttagtggcacatagtccaaatttttaaaaagcaagacccttgaatatgccaagagaaaatctaaagctagcaaacttaaaaaacaaaacaaaaattacacgtcgtgtacagttatgaatttagaatagcacactttttccattcagatttcatacatttgagccaaattcttatactccatgttttaattttaaaaggataattttaatccaagatttaaatctttgaaaatatctttcttatagaaaactttaatgcagtttttaaacttactgatttctgtggaaaacctttcttttctatagaaatactgtagtgccctttcttcccatcttgattttgtacatgtaaagacaaatgatgattcagtttcaatattgcatgaacaattgccactttgtaaattatatggacagaatgtgttctaaggaaattcgttagtaaatttgtgaaaaacatgtgagattgttcgagacctattaggctattcttcagttttgatgctcagttttacaacttaaatgattttctccaggacacggagctcagaataataaagcttttattaatggtctagtgaagatctagttgaacatggaaacattgtaatttacaaatgtctcagaaatttctcacttttatttgctaagacctgaatttaatatttgatattcaaaaacaagttattttgaagagacaatgggtctctttgagcttaagaaagctatggactatctttccttcaaatgcacatcacatgtctgtgaacactcaaaatgctcatagaatttcagggccctcagacggccagcttccacccctgtaccccctcaggggctaatgaacccaagtcaaaaggctgctctaaagttgttctgataatgtgttttgaaatgaggaagtgattaggcctccactagagatacttttgagatgatgcttaccaccttctgacctggaatcatttttataacttaaagactttatgtaatttagtagcaggttagggaatagaaaccacactaatctgaaggaataacaagatgatcaacactgaatcttcatgacagtaagattttctttccttggaggtatgagggtgtgtatgtgtgtgtgtgtgtgtgtgtgtttgtgtgtgtgtgtgtgtgtcctggcggttatttgggggcaaggtaccagattatttgcagtgagccaaaaaaaaaaaaatatccaagaagaaataaatagggaatccttgtaattaatccatctaccaaaacacttgattctttttattgtagctcagctatgacattatgacattatgtggcttagtgttatcagtatactactgtcttaaaatatatttgtcaacatgtccagttccaacaacagttgaagatgatgataaattagcaaactcaagggtagtccatagttggcaaaaaataaatttggtagaaagttggaggagcagatgctgaaggtagaaatgcaaaagatgttttttcttcctgcataaatcacggaggtgtgttctgttttagtgttttccagtcacccactagagcagcttcagattcctctgccaatagaactccacccccagtcccttacctactctatcttctttagggaagcatgtggatttcttcacatctgcaccttactattaggtaagggtgctgcatctacatggaaggctccctgggcccttgaaaaagcaggcagaaactcatcaaggggtttgaagttcttgtgaaatttgatcccagtggctcatgacttatagtcaggcatcaaaccatttcctactttttcaggctgaagaaagtggaaatataactggctggtgaagaaaggagaaaagtcagccccctaccccaccccacactcctagaaaagtttgggggttttttttgtttgtttttggtgtttttttgagacggagtctcgctctatcgccagcttagagtgcagtggctcaatcttagctcactgcaacctccacctcccaggttcaagtgattctcctgcatcagcctcctgagtagctgggaccacaggcatgtgccaccacacccagctaatttttgtatttttagtagagacggggtttcaccacgttggccaggccaatctcgaactcctgacctcaggtgatccacccgcctcagcctcccaaagtgctgggattacaggcatgagccaccgcgcccggcctagaagagttttaatgaaccttccacagtagtaaatgcagagaccactggtggaaattcccatgttggatagaaaagggcgtaagtccagtctaagtatctaaatgtgatatgcccttttgtcacagaagtgtaagacttaaagggaatattctgaccttcgtgtatgaatctgatccacccatcctgtcagctaggattataatttgaactgtcgtttcaggagcatgtgttaaatcatatgagtaaaaaaaaagtagacattgaaaagaagacttgggaataattgggcagatagaatgggttccatggatcattctagttgccactagaaaatgtgagctccttcttcatttaccatgttgataatccggtggtgactttttttttttttttgtaaattgtattagataccccacaggaatgtgacaataataggatagctttgggggctggtgatttgaaacagggactattaagtagattttcccccatcctctaggttcctgtagtctgtgctcagaacttggtttttggcccctattgtttttgcctattttgattttcagagatgatcacatggggacagttaacttttcttctgctgtgttgccttaatgctactagattgtgttgtgttgttggagttttctgacttcttccctataaaaagatactgagagctccataatgaaagaagttgttatactttctcagaatattctggaccactgaatgcacttctaatagagctttaatctaaagaagttagttcagtggttattaactgattttattacaggagaaaaaaactttaacaaaaaggcagggagaaaagtgtgaagggcatcaagcaaaatgacaggggcttcaaaaaacaaccaaagacaaaaccctatcttctgaagaccaaaggtccaactttacttactggctggcacagcctttctgaactccttgagtttagaatagagctcctagaataataaggcggccaaatttaaagatcagtcaatacagtagggacctgctattgatctctcaggcactgagtcttcacatccagtgtcaagcccagcccagcatatggggtgatatgagcagaaaacacacatcggtgtgtcttgatttctcgcagctgtgtaatgtggcatgagaagtatgttttggtgccacatatttctcaatctgatgcctttttgtctttttttttttttgccatttgcatcctatttcatagtgccaaaatgaatttttgtatcttgtcttgtctttgtccattataaactggaggatcacagttaagccttccatgaattcatagtttggaatcatttaccttaccattattttggatttttttcttattacagtgtcactacactgtattcatgtgggggaacaaacatgtaggtgcttgaacatgccccacagacacagttgtagccctagtatttgtgacggtcattattgacacagtgcagactttgcagatggagcattatgctctcagaggactttaaaaatatgtatattaagcaattaactttctggagttggagttatcaaatcttgctgggaaattaacttccaagagctctgaattggatggaattccatctggcttcagagaacaatcagcctatatgaaacggagctttgaaatgtttttcttgtgcagaaatacgaactagaaagaaaagtgctgatctaatgctaagttttctctgtgtactgactcagttgccagaattataatgaaaactgtattttagtctaacaaatgtatagaattttttatgtaataaataaaattttataggaaagaa

SEQ ID NO: 29230 - DNA, 3434 bp, Homo sapiens
ggtttgggccgccccgcctggcgctgtgctgggaggagccgccgccagtcgcgcggtcagtgcctccctccagactcgggagggtcgagggggcgcgggagagagcgcgggcggccgccggggctggtcgcctgcagggatgggggacgagcggccccactactacgggaaacacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgacagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcaagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacaggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatgtcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaactcctggccccaggggaaagaggggggggtctcccgtttcctgtgcctgcaccagccctgcccccattgcgtctgcacacccctgcgtgtaactgcattccaaccactaataaagtgcctattgtacaggtcca

SEQ ID NO: 29231 - DNA, 2199 bp, Homo sapiens
agtgcctccctccagactcgggagggtcgagggggcgcgggagagagcgcgggcggccgccggggctggtcgcctgcagggatgggggacgagcggccccactactacgggaaacacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgacagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcaagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttctgtgaggacctggaaaggaatgacggctctcaggagcgaccctacttcatgtcgcccgagctgagagacatcctgttgaaggggagtgcggaggaggggaagcgg

SEQ ID NO: 29232 - DNA, 3375 bp, Homo sapiens
gcggggcgctgcagcccgcggagcctcccgcccgcccgggctggggtcgcgctggctcggactccgctccccgccccgccgcggccatggaggacgagcggaaaaacggagcctacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgacagccggggcgagttctgcgggcagaagggcacaaaaaacgagaacaaaccctatctgttttatttcaacattgtgaaatgtgccagccccctggttctgctggaattccaatgtcccactccccagatctgcgtggaaaaatgccccgaccgctacctcacgtacctgaatgctcgcagctcccgggactttgagtactataagcagttctgtgttcctggcttcaagaacaataaaggagtggctgaggtgcttcaagatggtgactgccctgctgtcctcatccccagcaaacccttggcccggagatgcttccccgctatccacgcctacaagggtgtcctgatggtgggcaatgagacgacctatgaggatgggcatggctcccggaaaaacatcacagacctggtggagggcgccaagaaagccaatggagtcctagaggcgcggcaactcgccatgcgcatatttgaagattacaccgtctcttggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgaggccggctctgatgtctctttggtggacctcggctttcagacggatttccgggtgtacctgcacttacggcagacctggttggcctttatgatcattctgagtatccttgaagtcattatcatcttgctgctcatctttctccggaagagaattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagtcccgccaatgccccaatgcccgttgccagttcgccttctacggtggtgagtcgggctaccaccgggccctgctgggcctgcagatcttcaatgccttcatgttcttctggttggccaacttcgtgctggcgctgggccaggtcacgctggccggggcctttgcctcctactactgggccctgcgcaagccggacgacctgccggccttcccgctcttctctgcctttggccgggcgctcaggtaccacacaggctccctggcctttggcgcgctcatcctggccattgtgcagatcatccgtgtgatactcgagtacctggatcagcggctgaaagctgcagagaacaagtttgccaagtgcctcatgacctgtctcaaatgctgcttctggtgcctggagaagttcatcaaattccttaataggaatgcctacatcatgattgccatctacggcaccaatttctgcacctcggccaggaatgccttcttcctgctcatgagaaacatcatcagagtggctgtcctggataaagttactgacttcctcttcctgttgggcaaacttctgatcgttggtagtgtggggatcctggctttcttcttcttcacccaccgtatcaggatcgtgcaggatacagcaccacccctcaattattactgggttcctatactgacggtgatcgttggctcctacttgattgcacacggtttcttcagcgtctatggcatgtgtgtggacacgctgttcctctgcttcttggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacaggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatgtcagggggagaggtggagggcagatgtcctgggcaaaccgggcccctctgcccacacacctcacttgatccttttgccaaacttgtcaaactcaggggaactggcttcccagttgcccctttgccatattccaagtccccctcagacttcatgtctctgctcatcagcactgtcccaggatcctggagagggagaactcctggccccaggggaaagaggggggggtctcccgtttcctgtgcctgcaccagccctgcccccattgcgtctgcacacccctgcgtgtaactgcattccaaccactaataaagtgcctattgtacaggtcca

SEQ ID NO: 29233 - DNA, 2589 bp, Homo sapiens
aatcactccggagactgagccatggggggaaagcagcgggacgaggatgacgaggcctacgggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccaggtgtgtgtgtcctcctgcccggaggacccatggactgtgggaaaaaacgagttctcacagactgttggggaagtcttctatacaaaaaacaggaacttttgtctgccaggggtaccctggaatatgacggtgatcacaagcctgcaacaggaactctgccccagtttcctcctcccctctgctccagctctggggcgctgctttccatggaccaacgttactccaccggcgctcccagggatcaccaatgacaccaccatacagcaggggatcagcggtcttattgacagcctcaatgcccgagacatcagtgttaagatctttgaagattttgcccagtcctggtattggattcttgttgccctgggggtggctctggtcttgagcctactgtttatcttgcttctgcgcctggtggctgggcccctggtgctggtgctgatcctgggagtgctgggcgtgctggcatacggcatctactactgctgggaggagtaccgagtgctgcgggacaagggcgcctccatctcccagctgggtttcaccaccaacctcagtgcctaccagagcgtgcaggagacctggctggccgccctgatcgtgttggcggtgcttgaagccatcctgctgctgatgctcatcttcctgcggcagcggattcgtattgccatcgccctcctgaaggaggccagcaaggctgtgggacagatgatgtctaccatgttctacccactggtcacctttgtcctcctcctcatctgcattgcctactgggccatgactgctctgtacctggctacatcggggcaaccccagtatgtgctctgggcatccaacatcagctcccccggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagaggagtgcagaaccctgtagcccgctgcatcatgtgctgtttcaagtgctgcctctggtgtctggaaaaatttatcaagttcctaaaccgcaatgcatacatcatgatcgccatctacgggaagaatttctgtgtctcagccaaaaatgcgttcatgctactcatgcgaaacattgtcagggtggtcgtcctggacaaagtcacagacctgctgctgttctttgggaagctgctggtggtcggaggcgtgggggtcctgtccttcttttttttctccggtcgcatcccggggctgggtaaagactttaagagcccccacctcaactattactggctgcccatcatgacctccatcctgggggcctatgtcatcgccagcggcttcttcagcgttttcggcatgtgtgtggacacgctcttcctctgcttcctggaagacctggagcggaacaacggctccctggaccggccctactacatgtccaagagccttctaaagattctgggcaagaagaacgaggcgcccccggacaacaagaagaggaagaagtgacagctccggccctgatccaggactgcaccccacccccaccgtccagccatccaacctcacttcgccttacaggtctccattttgtggtaaaaaaaggttttaggccaggcgccgtggctcacgcctgtaatccaacactttgagaggctgaggcgggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactcagtaaa

SEQ ID NO: 29234 - DNA, 2505 bp, Homo sapiens
agggcggggcgggcagcaggtgagacgccaggtctccagggctccaatcactccggagactgagccatggggggaaagcagcgggacgaggatgacgaggcctacgggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccagacggtgatcacaagcctgcaacaggaactctgccccagtttcctcctcccctctgctccagctctggggcgctgctttccatggaccaacgttactccaccggcgctcccagggatcaccaatgacaccaccatacagcaggggatcagcggtcttattgacagcctcaatgcccgagacatcagtgttaagatctttgaagattttgcccagtcctggtattggattcttgttgccctgggggtggctctggtcttgagcctactgtttatcttgcttctgcgcctggtggctgggcccctggtgctggtgctgatcctgggagtgctgggcgtgctggcatacggcatctactactgctgggaggagtaccgagtgctgcgggacaagggcgcctccatctcccagctgggtttcaccaccaacctcagtgcctaccagagcgtgcaggagacctggctggccgccctgatcgtgttggcggtgcttgaagccatcctgctgctgatgctcatcttcctgcggcagcggattcgtattgccatcgccctcctgaaggaggccagcaaggctgtgggacagatgatgtctaccatgttctacccactggtcacctttgtcctcctcctcatctgcattgcctactgggccatgactgctctgtacctggctacatcggggcaaccccagtatgtgctctgggcatccaacatcagctcccccggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagaggagtgcagaaccctgtagcccgctgcatcatgtgctgtttcaagtgctgcctctggtgtctggaaaaatttatcaagttcctaaaccgcaatgcatacatcatgatcgccatctacgggaagaatttctgtgtctcagccaaaaatgcgttcatgctactcatgcgaaacattgtcagggtggtcgtcctggacaaagtcacagacctgctgctgttctttgggaagctgctggtggtcggaggcgtgggggtcctgtccttcttttttttctccggtcgcatcccggggctgggtaaagactttaagagcccccacctcaactattactggctgcccatcatgacctccatcctgggggcctatgtcatcgccagcggcttcttcagcgttttcggcatgtgtgtggacacgctcttcctctgcttcctggaagacctggagcggaacaacggctccctggaccggccctactacatgtccaagagccttctaaagattctgggcaagaagaacgaggcgcccccggacaacaagaagaggaagaagtgacagctccggccctgatccaggactgcaccccacccccaccgtccagccatccaacctcacttcgccttacaggtctccattttgtggtaaaaaaaggttttaggccaggcgccgtggctcacgcctgtaatccaacactttgagaggctgaggcgggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactcagt

SEQ ID NO: 29235 - DNA, 2589 bp, Homo sapiens; identical to SEQ ID NO: 29233

SEQ ID NO: 29236 - DNA, 1233 bp, Homo sapiens
agcgggacgaggatgacgaggcctacgggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccaggtgtgtgtgtcctcctgcccggaggacccatggactgtgggaaaaaacgagttctcacagactgttggggaagtcttctatacaaaaaacaggaacttttgtctgccaggggtaccctggaatatgacggtgatcacaagcctgcaacaggaactctgccccagtttcctcctcccctctgctccagctctggggcgctgctttccatggaccaacgttactccaccggcgctcccagggatcaccaatgacaccaccatacagcaggggatcagcggtcttattgacagcctcaatgcccgagacatcagtgttaagatctttgaagattttgcccagtcctggtattggattcttgtggctgtgggacagatgatgtctaccatgttctacccactggtcacctttgtcctcctcctcatctgcattgcctactgggccatgactgctctgtacctggctacatcggggcaaccccagtatgtgctctgggcatccaacatcagctcccccggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagag

SEQ ID NO: 29237 - DNA, 1233 bp, Homo sapiens
agcgggacgaggatgacgaggcctacgggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccaggtgtgtgtgtcctcctgcccggaggacccatggactgtgggaaaaaacgagttctcacagactgttggggaagtcttctatacaaaaaacaggaacttttgtctgccaggggtaccctggaatatgacggtgatcacaagcctgcaacaggaactctgccccagtttcctcctcccctctgctccagctctgggacgctgctttccatggaccaacattactccaccggcgctcccagggatcaccaatgacaccaccatacagcaggggatcagcggtcttattgacagcctcaatgcccgagacatcagtgttaagatctttgaagattttgcccagtcctggtattggattcttgtggctgtgggacagatgatgtctaccatgttctacccactggtcacctttgtcctcctcctcatctgcattgcctactgggccatgactgctctgtacctggctacatcggggcaaccccagtatgtgctctgggcatccaacatcagctcccccggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagag

SEQ ID NO: 29238 - DNA, 2589 bp, Homo sapiens
aatcactccggagactgagccatggggggaaagcagcgggacgaggatgacgaggcctacgggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccaggtgtgtgtgtcctcctgcccggaggacccatggactgtgggaaaaaacgagttctcacagactgttggggaagtcttctatacaaaaaacaggaacttttgtctgccaggggtaccctggaatatgacggtgatcacaagcctgcaacaggaactctgccccagtttcctcctcccctctgctccagctctgggacgctgctttccatggaccaacattactccaccggcgctcccagggatcaccaatgacaccaccatacagcaggggatcagcggtcttattgacagcctcaatgcccgagacatcagtgttaagatctttgaagattttgcccagtcctggtattggattcttgttgccctgggggtggctctggtcttgagcctactgtttatcttgcttctgcgcctggtggctgggcccctggtgctggtgctgatcctgggagtgctgggcgtgctggcatatggcatctactactgctgggaggagtaccgagtgctgcgggacaagggcgcctccatctcccagctgggtttcaccaccaacctcagtgcctaccagagcgtgcaggagacctggctggccgccctgatcgtgttggcggtgcttgaagccatcctgctgctggtgctcatcttcctgcggcagcggattcgtattgccatcgccctcctgaaggaggccagcaaggctgtgggacagatgatgtctaccatgttctacccactggtcacctttgtcctcctcctcatctgcattgcctactgggccatgactgctctgtacctggctacatcggggcaaccccagtatgtgctctgggcatccaacatcagctcccccggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagaggagtgcagaaccctgtagcccgctgcatcatgtgctgtttcaagtgctgcctctggtgtctggaaaaatttatcaagttcctaaaccgcaatgcatacatcatgatcgccatctacgggaagaatttctgtgtctcagccaaaaatgcgttcatgctactcatgcgaaacattgtcagggtggtcgtcctggacaaagtcacagacctgctgctgttctttgggaagctgctggtggtcggaggcgtgggggtcctgtccttcttttttttctccggtcgcatcccggggctgggtaaagactttaagagcccccacctcaactattactggctgcccatcatgacctccatcctgggggcctatgtcatcgccagcggcttcttcagcgttttcggcatgtgtgtggacacgctcttcctctgcttcctggaagacctggagcggaacaacggctccctggaccggccctactacatgtccaagagccttctaaagattctgggcaagaagaacgaggcgcccccggacaacaagaagaggaagaagtgacagctccggccctgatccaggactgcaccccacccccaccgtccagccatccaacctcacttcgccttacaggtctccattttgtggtaaaaaaaggttttaggccaggcgccgtggctcacgcctgtaatccaacactttgagaggctgaggcgggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactcagtaaa

SEQ ID NO: 29239 - DNA, 2589 bp, Homo sapiens; identical to SEQ ID NO: 29238

SEQ ID NO: 29240 - DNA, 2589 bp, Homo sapiens; identical to SEQ ID NO: 29233

SEQ ID NO: 29241 - DNA, 1233 bp, Homo sapiens; identical to SEQ ID NO: 29236

SEQ ID NO: 29242 - DNA, 1233 bp, Homo sapiens; identical to SEQ ID NO: 29236

SEQ ID NO: 29243 - DNA, 1233 bp, Homo sapiens; identical to SEQ ID NO: 29237

SEQ ID NO: 29244 - DNA, 2589 bp, Homo sapiens; identical to SEQ ID NO: 29238

SEQ ID NO: 29245 - DNA, 1233 bp, Homo sapiens; identical to SEQ ID NO: 29237

SEQ ID NO: 29246 - DNA, 2589 bp, Homo sapiens; identical to SEQ ID NO: 29233

SEQ ID NO: 29247 - DNA, 1233 bp, Homo sapiens; identical to SEQ ID NO: 29236

SEQ ID NO: 29248 - DNA, 2634 bp, Homo sapiens
actgaggtcccaccagagtgaggatgtacagggccgcttccctccccaggccctgctggggttgacacctttgtctccagtttctttccccatagccttgaaccagaggggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccaggtgtgtgtgtcctcctgcccggaggacccatggactgtgggaaaaaacgagttctcacagactgttggggaagtcttctatacaaaaaacaggaacttttgtctgccaggggtaccctggaatatgacggtgatcacaagcctgcaacaggaactctgccccagtttcctcctcccctctgctccagctctggggcgctgctttccatggaccaacgttactccaccggcgctcccagggatcaccaatgacaccaccatacagcaggggatcagcggtcttattgacagcctcaatgcccgagacatcagtgttaagatctttgaagattttgcccagtcctggtattggattcttgttgccctgggggtggctctggtcttgagcctactgtttatcttgcttctgcgcctggtggctgggcccctggtgctggtgctgatcctgggagtgctgggcgtgctggcatacggcatctactactgctgggaggagtaccgagtgctgcgggacaagggcgcctccatctcccagctgggtttcaccaccaacctcagtgcctaccagagcgtgcaggagacctggctggccgccctgatcgtgttggcggtgcttgaagccatcctgctgctgatgctcatcttcctgcggcagcggattcgtattgccatcgccctcctgaaggaggccagcaaggctgtgggacagatgatgtctaccatgttctacccactggtcacctttgtcctcctcctcatctgcattgcctactgggccatgactgctctgtacctggctacatcggggcaaccccagtatgtgctctgggcatccaacatcagctcccccggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagaggagtgcagaaccctgtagcccgctgcatcatgtgctgtttcaagtgctgcctctggtgtctggaaaaatttatcaagttcctaaaccgcaatgcatacatcatgatcgccatctacgggaagaatttctgtgtctcagccaaaaatgcgttcatgctactcatgcgaaacattgtcagggtggtcgtcctggacaaagtcacagacctgctgctgttctttgggaagctgctggtggtcggaggcgtgggggtcctgtccttcttttttttctccggtcgcatcccggggctgggtaaagactttaagagcccccacctcaactattactggctgcccatcatgacctccatcctgggggcctatgtcatcgccagcggcttcttcagcgttttcggcatgtgtgtggacacgctcttcctctgcttcctggaagacctggagcggaacaacggctccctggaccggccctactacatgtccaagagccttctaaagattctgggcaagaagaacgaggcgcccccggacaacaagaagaggaagaagtgacagctccggccctgatccaggactgcaccccacccccaccgtccagccatccaacctcacttcgccttacaggtctccattttgtggtaaaaaaaggttttaggccaggcgccgtggctcacgcctgtaatccaacactttgagaggctgaggcgggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactcagt

SEQ ID NO: 29249 - DNA, 2634 bp, Homo sapiens; identical to SEQ ID NO: 29248

SEQ ID NO: 29250 - DNA, 2634 bp, Homo sapiens
actgaggtcccaccagagtgaggatgtacagggccgcttccctccccaggccctgctggggttgacacctttgtctccagtttctttccccatagccttgaaccagaggggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccaggtgtgtgtgtcctcctgcccggaggacccatggactgtgggaaaaaacgagttctcacagactgttggggaagtcttctatacaaaaaacaggaacttttgtctgccaggggtaccctggaatatgacggtgatcacaagcctgcaacaggaactctgccccagtttcctcctcccctctgctccagctctgggacgctgctttccatggaccaacattactccaccggcgctcccagggatcaccaatgacaccaccatacagcaggggatcagcggtcttattgacagcctcaatgcccgagacatcagtgttaagatctttgaagattttgcccagtcctggtattggattcttgttgccctgggggtggctctggtcttgagcctactgtttatcttgcttctgcgcctggtggctgggcccctggtgctggtgctgatcctgggagtgctgggcgtgctggcatatggcatctactactgctgggaggagtaccgagtgctgcgggacaagggcgcctccatctcccagctgggtttcaccaccaacctcagtgcctaccagagcgtgcaggagacctggctggccgccctgatcgtgttggcggtgcttgaagccatcctgctgctggtgctcatcttcctgcggcagcggattcgtattgccatcgccctcctgaaggaggccagcaaggctgtgggacagatgatgtctaccatgttctacccactggtcacctttgtcctcctcctcatctgcattgcctactgggccatgactgctctgtacctggctacatcggggcaaccccagtatgtgctctgggcatccaacatcagctcccccggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagaggagtgcagaaccctgtagcccgctgcatcatgtgctgtttcaagtgctgcctctggtgtctggaaaaatttatcaagttcctaaaccgcaatgcatacatcatgatcgccatctacgggaagaatttctgtgtctcagccaaaaatgcgttcatgctactcatgcgaaacattgtcagggtggtcgtcctggacaaagtcacagacctgctgctgttctttgggaagctgctggtggtcggaggcgtgggggtcctgtccttcttttttttctccggtcgcatcccggggctgggtaaagactttaagagcccccacctcaactattactggctgcccatcatgacctccatcctgggggcctatgtcatcgccagcggcttcttcagcgttttcggcatgtgtgtggacacgctcttcctctgcttcctggaagacctggagcggaacaacggctccctggaccggccctactacatgtccaagagccttctaaagattctgggcaagaagaacgaggcgcccccggacaacaagaagaggaagaagtgacagctccggccctgatccaggactgcaccccacccccaccgtccagccatccaacctcacttcgccttacaggtctccattttgtggtaaaaaaaggttttaggccaggcgccgtggctcacgcctgtaatccaacactttgagaggctgaggcgggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactcagt

SEQ ID NO: 29251 - DNA, 2505 bp, Homo sapiens
agggcggggcgggcagcaggtgagacgccaggtctccagggctccaatcactccggagactgagccatggggggaaagcagcgggacgaggatgacgaggcctacgggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccagacggtgatcacaagcctgcaacaggaactctgccccagtttcctcctcccctctgctccagctctgggacgctgctttccatggaccaacattactccaccggcgctcccagggatcaccaatgacaccaccatacagcaggggatcagcggtcttattgacagcctcaatgcccgagacatcagtgttaagatctttgaagattttgcccagtcctggtattggattcttgttgccctgggggtggctctggtcttgagcctactgtttatcttgcttctgcgcctggtggctgggcccctggtgctggtgctgatcctgggagtgctgggcgtgctggcatatggcatctactactgctgggaggagtaccgagtgctgcgggacaagggcgcctccatctcccagctgggtttcaccaccaacctcagtgcctaccagagcgtgcaggagacctggctggccgccctgatcgtgttggcggtgcttgaagccatcctgctgctggtgctcatcttcctgcggcagcggattcgtattgccatcgccctcctgaaggaggccagcaaggctgtgggacagatgatgtctaccatgttctacccactggtcacctttgtcctcctcctcatctgcattgcctactgggccatgactgctctgtacctggctacatcggggcaaccccagtatgtgctctgggcatccaacatcagctcccccggctgtgagaaagtgccaataaatacatcatgcaaccccacggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccgttaccacactgggtcattggcatttggagccctcatcctgacccttgtgcagatagcccgggtcatcttggagtatattgaccacaagctcagaggagtgcagaaccctgtagcccgctgcatcatgtgctgtttcaagtgctgcctctggtgtctggaaaaatttatcaagttcctaaaccgcaatgcatacatcatgatcgccatctacgggaagaatttctgtgtctcagccaaaaatgcgttcatgctactcatgcgaaacattgtcagggtggtcgtcctggacaaagtcacagacctgctgctgttctttgggaagctgctggtggtcggaggcgtgggggtcctgtccttcttttttttctccggtcgcatcccggggctgggtaaagactttaagagcccccacctcaactattactggctgcccatcatgacctccatcctgggggcctatgtcatcgccagcggcttcttcagcgttttcggcatgtgtgtggacacgctcttcctctgcttcctggaagacctggagcggaacaacggctccctggaccggccctactacatgtccaagagccttctaaagattctgggcaagaagaacgaggcgcccccggacaacaagaagaggaagaagtgacagctccggccctgatccaggactgcaccccacccccaccgtccagccatccaacctcacttcgccttacaggtctccattttgtggtaaaaaaaggttttaggccaggcgccgtggctcacgcctgtaatccaacactttgagaggctgaggcgggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactcagt

SEQ ID NO: 29252 - DNA, 2634 bp, Homo sapiens; identical to SEQ ID NO: 29248

SEQ ID NO: 29253 - DNA, 2634 bp, Homo sapiens; identical to SEQ ID NO: 29248

SEQ ID NO: 29254 - DNA, 2505 bp, Homo sapiens; identical to SEQ ID NO: 29234

SEQ ID NO: 29255 - DNA, 2505 bp, Homo sapiens; identical to SEQ ID NO: 29234

SEQ ID NO: 29256 - DNA, 2505 bp, Homo sapiens; identical to SEQ ID NO: 29251

SEQ ID NO: 29257 - DNA, 2634 bp, Homo sapiens; identical to SEQ ID NO: 29250

SEQ ID NO: 29258 - DNA, 2505 bp, Homo sapiens; identical to SEQ ID NO: 29234

SEQ ID NO: 29259 - DNA, 2505 bp, Homo sapiens; identical to SEQ ID NO: 29251

SEQ ID NO: 29260 - DNA, 2634 bp, Homo sapiens; identical to SEQ ID NO: 29250

SEQ ID NO: 29261 - DNA, 2401 bp, Homo sapiens
atgatccccgcagccagcagcaccccgccgggagatgccctcttccccagcgtggccccacaggacttctggaggtcccaggtcacgggctactcggggtccgtgacacgacacctcagtcaccgggccaacaacttcaaacgacaccccaagaggaggaagtgcattcgtccctccccacccccgccccccaacaccccgtgcccgcttgagctggtggacttcggggacctgcacccccagaggtccttccgggagctgcttttcaacggctgcattctctttggcatcgagttcagctacgccatggagacggcgtacgtgaccccggtgctcctgcagatgggcctgcccgaccagctctacagcctggtgtggttcatcagccccatcctcggattcctactgcagcctctgttgggtgcttggagtgaccggtgtacctcaaggtttggaaggagacgccctttcattcttgtcctggctataggggcactgctgggcctctcgctcttgctgaatggccgggacattggcatcgccctggctgacgtgaccgggaaccacaagtggggcctgctgctgaccgtgtgcggtgtggtgctgatggactttagcgccgactcggcggacaaccccagccacgcctacatgatggacgtgtgcagccccgcagaccaggaccgaggcctgaacatccacgccctcctggcaggtctcggaggaggctttggatacgtggtcggcggaatccactgggataaaacgggcttcgggagggccctggggggacagctccgagtcatttacctcttcactgcggtcaccctgagcgtcaccaccgtcctgaccctggtcagcatccctgagaggccgctgcggccgccgagtgagaagcgggcagccatgaagagccccagcctcccgctgcccccgtccccacccgtcctgccagaggaaggccctggcgacagcctcccgtcgcacacggccaccaacttctccagccccatctcgccgcccagccccctcacgcccaagtacggcagcttcatcagcagggacagctccctgacgggcatcagcgagttcgcctcatcctttggcacggccaacatagacagcgtcctcattgactgcttcacgggcggccacgacagctacctggccatccctggcagcgtccccaggccgcccatcagcgtcagcttcccccgggcccccgacggcttctaccgccaggaccgtggacttctggagggcagagagggtgccctgacctccggctgtgacggggacattctgagggtgggctccttggacacctctaagccgaggtcatcagggattctgaagagacctcagaccttggccatcccggacgcagccggaggagggggtcccgaaaccagcaggagaaggaatgtgaccttcagtcagcaggtggccaatatcctgctcaacggcgtgaagtatgagagcgagctgacgggctccagcgagcgcgcggagcagcctctgtccgtggggcgcctctgctccaccatctgcaacatgcccaaggcgctacgcaccctctgcgtcaaccacttcctggggtggctctcattcgaggggatgttgctcttctacacagacttcatgggcgaggtggtgtttcagggggaccccaaggccccgcacacatcagaggcgtatcagaagtacaacagcggcgtgaccatgggctgctggggcatgtgtatctacgccttcagtgctgccttctactcagctatcctggagaagctggaggagttcctcagcgtccgcaccctctacttcatcgcctatctcgccttcggcctggggaccgggcttgccaccctctccaggaacctctacgtggtcctgtcgctctgcataacctacgggattttattttccaccctgtgcaccttgccttactcgctgctctgcgattactatcagagtaagaagtttgcagggtccagtgcggacggcacccggcggggcatgggcgtggacatctctctgctgagctgccagtacttcctggctcagattctggtctccctggtcctggggcccctgacctcggccgtgggcagtgccaacggggtgatgtacttctccagcctcgtgtccttcctgggctgcctgtactcctccctgtttgtcatttatgaaattcctcccagcgacgctgcagacgaggagcaccggcccctcctgctgaacgtctgacatcgcggagcctcgactccggacacgcgcctgcacctgggggtctggagcaggccgaccagtgaggaccaaagggccttgttggacagggggactggctgcctactggaatgtaaatatgtgataaaataataaatgacagcggcaaagccta

SEQ ID NO: 29262 - DNA, 2503 bp, Homo sapiens
atgctgcagcagccgggaccgcggccgggcaggcagcagcccagcggggacagggatgcctgccgtctccacccacagggacgcccaccagccctccccacgatgatccccgcagccagcagcaccccgccgggagatgccctcttccccagcgtggccccacaggacttctggaggtcccaggtcacgggctactcggggtccgtgacacgacacctcagtcaccgggccaacaacttcaaacgacaccccaagaggaggaagtgcattcgtccctccccacccccgccccccaacaccccgtgcccgcttgagctggtggacttcggggacctgcacccccagaggtccttccgggagctgcttttcaacggctgcattctctttggcatcgagttcagctacgccatggagacggcgtacgtgaccccggtgctcctgcagatgggcctgcccgaccagctctacagcctggtgtggttcatcagccccatcctcggattcctactgcagcctctgttgggtgcttggagtgaccggtgtacctcaaggtttggaaggagacgccctttcattcttgtcctggctataggggcactgctgggcctctcgctcttgctgaatggccgggacattggcatcgccctggctgacgtgaccgggaaccacaagtggggcctgctgctgaccgtgtgcggtgtggtgctgatggactttagcgccgactcggcggacaaccccagccacgcctacatgatggacgtgtgcagccccgcagaccaggaccgaggcctgaacatccacgccctcctggcaggtctcggaggaggctttggatacgtggtcggcggaatccactgggataaaacgggcttcgggagggccctggggggacagctccgagtcatttacctcttcactgcggtcaccctgagcgtcaccaccgtcctgaccctggtcagcatccctgagaggccgctgcggccgccgagtgagaagcgggcagccatgaagagccccagcctcccgctgcccccgtccccacccgtcctgccagaggaaggccctggcgacagcctcccgtcgcacacggccaccaacttctccagccccatctcgccgcccagccccctcacgcccaagtacggcagcttcatcagcagggacagctccctgacgggcatcagcgagttcgcctcatcctttggcacggccaacatagacagcgtcctcattgactgcttcacgggcggccacgacagctacctggccatccctggcagcgtccccaggccgcccatcagcgtcagcttcccccgggcccccgacggcttctaccgccaggaccgtggacttctggagggcagagagggtgccctgacctccggctgtgacggggacattctgagggtgggctccttggacacctctaagccgaggtcatcagggattctgaagagacctcagaccttggccatcccggacgcagccggaggagggggtcccgaaaccagcaggagaaggaatgtgaccttcagtcagcaggtggccaatatcctgctcaacggcgtgaagtatgagagcgagctgacgggctccagcgagcgcgcggagcagcctctgtccgtggggcgcctctgctccaccatctgcaacatgcccaaggcgctacgcaccctctgcgtcaaccacttcctggggtggctctcattcgaggggatgttgctcttctacacagacttcatgggcgaggtggtgtttcagggggaccccaaggccccgcacacatcagaggcgtatcagaagtacaacagcggcgtgaccatgggctgctggggcatgtgtatctacgccttcagtgctgccttctactcagctatcctggagaagctggaggagttcctcagcgtccgcaccctctacttcatcgcctatctcgccttcggcctggggaccgggcttgccaccctctccaggaacctctacgtggtcctgtcgctctgcataacctacgggattttattttccaccctgtgcaccttgccttactcgctgctctgcgattactatcagagtaagaagtttgcagggtccagtgcggacggcacccggcggggcatgggcgtggacatctctctgctgagctgccagtacttcctggctcagattctggtctccctggtcctggggcccctgacctcggccgtgggcagtgccaacggggtgatgtacttctccagcctcgtgtccttcctgggctgcctgtactcctccctgtttgtcatttatgaaattcctcccagcgacgctgcagacgaggagcaccggcccctcctgctgaacgtctgacatcgcggagcctcgactccggacacgcgcctgcacctgggggtctggagcaggccgaccagtgaggaccaaagggccttgttggacagggggactggctgcctactggaatgtaaatatgtgataaaataataaatgacagcggcaaagccta

SEQ ID NO: 29263 - DNA, 2784 bp, Homo sapiens
tttatacatgaagacacgaaaatgtatttatttcttttaaaatcagaagaaaacggtgagaactgtgaggccggggggacgttttcctccgggatcctggcagatcctgcagaccgcgccgtcgtgcgcgaagcaccgggacgggcctcccgcgggaagggcccaggaggacaccgggctcccctcccgcccgcggggccccagacgcggcgccgctttaaggctccgggccccgcgcggatgcggaggctgcggccgtgacgtcagcgccccgccccgggtgatgctgcagcagccgggaccgcggccgggcaggcagcagcccagcggggacagggatgcctgccgtctccacccacagggacgcccaccagccctccccacgatgatccccgcagccagcagcaccccgccgggagatgccctcttccccagcgtggccccacaggacttctggaggtcccaggtcacgggctactcggggtccgtgacacgacacctcagtcaccgggccaacaacttcaaacgacaccccaagaggaggaagtgcattcgtccctccccacccccgccccccaacaccccgtgcccgcttgagctggtggacttcggggacctgcacccccagaggtccttccgggagctgcttttcaacggctgcattctctttggcatcgagttcagctacgccatggagacggcgtacgtgaccccggtgctcctgcagatgggcctgcccgaccagctctacagcctggtgtggttcatcagccccatcctcggattcctactgcagcctctgttgggtgcttggagtgaccggtgtacctcaaggtttggaaggagacgccctttcattcttgtcctggctataggggcactgctgggcctctcgctcttgctgaatggccgggacattggcatcgccctggctgacgtgaccgggaaccacaagtggggcctgctgctgaccgtgtgcggtgtggtgctgatggactttagcgccgactcggcggacaaccccagccacgcctacatgatggacgtgtgcagccccgcagaccaggaccgaggcctgaacatccacgccctcctggcaggtctcggaggaggctttggatacgtggtcggcggaatccactgggataaaacgggcttcgggagggccctggggggacagctccgagtcatttacctcttcactgcggtcaccctgagcgtcaccaccgtcctgaccctggtcagcatccctgagaggccgctgcggccgccgagtgagaagcgggcagccatgaagagccccagcctcccgctgcccccgtccccacccgtcctgccagaggaaggccctggcgacagcctcccgtcgcacacggccaccaacttctccagccccatctcgccgcccagccccctcacgcccaagtacggcagcttcatcagcagggacagctccctgacgggcatcagcgagttcgcctcatcctttggcacggccaacatagacagcgtcctcattgactgcttcacgggcggccacgacagctacctggccatccctggcagcgtccccaggccgcccatcagcgtcagcttcccccgggcccccgacggcttctaccgccaggaccgtggacttctggagggcagagagggtgccctgacctccggctgtgacggggacattctgagggtgggctccttggacacctctaagccgaggtcatcagggattctgaagagacctcagaccttggccatcccggacgcagccggaggagggggtcccgaaaccagcaggagaaggaatgtgaccttcagtcagcaggtggccaatatcctgctcaacggcgtgaagtatgagagcgagctgacgggctccagcgagcgcgcggagcagcctctgtccgtggggcgcctctgctccaccatctgcaacatgcccaaggcgctacgcaccctctgcgtcaaccacttcctggggtggctctcattcgaggggatgttgctcttctacacagacttcatgggcgaggtggtgtttcagggggaccccaaggccccgcacacatcagaggcgtatcagaagtacaacagcggcgtgaccatgggctgctggggcatgtgtatctacgccttcagtgctgccttctactcagctatcctggagaagctggaggagttcctcagcgtccgcaccctctacttcatcgcctatctcgccttcggcctggggaccgggcttgccaccctctccaggaacctctacgtggtcctgtcgctctgcataacctacgggattttattttccaccctgtgcaccttgccttactcgctgctctgcgattactatcagagtaagaagtttgcagggtccagtgcggacggcacccggcggggcatgggcgtggacatctctctgctgagctgccagtacttcctggctcagattctggtctccctggtcctggggcccctgacctcggccgtgggcagtgccaacggggtgatgtacttctccagcctcgtgtccttcctgggctgcctgtactcctccctgtttgtcatttatgaaattcctcccagcgacgctgcagacgaggagcaccggcccctcctgctgaacgtctgacatcgcggagcctcgactccggacacgcgcctgcacctgggggtctggagcaggccgaccagtgaggaccaaagggccttgttggacagggggactggctgcctactggaatgtaaatatgtgataaaataataaatgacagcggcaaagcc

SEQ ID NO: 29264 - DNA, 1772 bp, Homo sapiens
ggcaggaaagaatttgagcccctcccccagcctgaccatctctgttggttgctcggccaggctccacgtcaaatccagtttgaaacacagaccctaggaccacgcaggaggtggtgggctcgcaggaaggttcctctcccagtggccatgggtagcaacagtgggcaggctggccgccacatctataaatccctagctgatgatggcccctttgactctgtggagccgcctaaaagacccaccagcagactcatcatgcacagcatggccatgttcggaagagagttctgctacgcggtggaggcagcgtatgtgaccccagtcctgctcagcgtaggtctgcccagcagcctgtacagcattgtgtggttcctcagccccatcctgggattcctgctgcagcccgtggtcggatcggccagcgaccactgccggtccaggtggggccgccggagaccctacatcctcaccctgggagtcatgatgctcgtgggcatggctctgtacctcaatggggctactgttgtagcagctttgattgctaacccaaggaggaagctggtttgggccataagtgtcaccatgataggtgtcgttctctttgattttgctgccgacttcattgatgggcccatcaaagcctacttatttgatgtctgctcccatcaggacaaggagaagggcctccactaccatgccctcttcacaggttttggaggtgccctgggttaccttttgggtgctatagactgggcccatctggagctgggaagactgttgggtacagaattccaggtcatgttcttcttctctgcattggtgctcactttgtgttttactgttcatctgtgcagtatctctgaagccccacttacagaggttgcaaagggcattcccccacagcaaacccctcaggaccctccattgtcatcagatggaatgtacgagtatggttctatcgagaaagttaaaaatggttacgtaaatccagagctggcaatgcagggagcaaaaaacaaaaatcatgctgaacagactcgcagggcaatgacattaaagtcactgctgagagcactggtgaacatgcctcctcactaccgctacctttgcatcagccacctcattggatggacagccttcctgtccaacatgctgttcttcacagatttcatgggccagattgtgtaccgcggggatccctatagtgcacacaactccacagagtttctcatctacgaaagaggagtcgaggttggatgttggggcttgtgcatcaactccgtgttttcctcactttattcttactttcagaaagttttggtatcctacattggattaaagggtctttacttcacgggatatttgctgtttggcctggggacgggatttattgggctcttcccgaatgtctactccaccctggtcctgtgcagcctgtttggtgtaatgtccagcaccctgtacactgtgccctttaacctcattactgagtaccaccgcgaggaagaaaaggagaggcagcaggccccaggaggggacccagacaacagcgtgagagggaagggcatggactgcgccaccctcacatgcatggtgcagctggctcagatcctggtcggaggtggcctgggctttctggtcaacacagccgggaccgttgtcgtcgtggtgatcacagcgtctgcggtggcactgataggctgttgctttgtcgctctctttgttagatatgtggattaggtcaataaagagacaatgaccctaacctcaga

SEQ ID NO: 29265 - DNA, 1537 bp, Homo sapiens
gccaggctccacgtcaaatccagtttgaaacacagaccctaggaccacgcaggaggtggtgggctcgcaggaaggttcctctcccagtggccatgggtagcaacagtgggcaggctggccgccacatctataaatccctagctgatgatggcccctttgactctgtggagccgcctaaaagacccaccagcagactcatcatgcacagcatggccatgttcggaagagagttctgctacgcggtggaggcagcgtatgtgaccccagtcctgctcagcgtaggtctgcccagcagcctgtacagcattgtgtggttcctcagccccatcctgggattcctgctgcagcccgtggtcggatcggccagcgaccactgccggtccaggtggggccgccggagaccctacatcctcaccctgggagtcatgatgctcgtgggcatggctctgtacctcaatggggctactgttgtagcaggttttggaggtgccctgggttaccttttgggtgctatagactgggcccatctggagctgggaagactgttgggtacagaattccaggtcatgttcttcttctctgcattggtgctcactttgtgttttactgttcatctgtgcagtatctctgaagccccacttacagaggttgcaaagggcattcccccacagcaaacccctcaggaccctccattgtcatcagatggaatgtacgagtatggttctatcgagaaagttaaaaatggttacgtaaatccagagctggcaatgcagggagcaaaaaacaaaaatcatgctgaacagactcgcagggcaatgacattaaagtcactgctgagagcactggtgaacatgcctcctcactaccgctacctttgcatcagccacctcattggatggacagccttcctgtccaacatgctgttcttcacagatttcatgggccagattgtgtaccgcggggatccctatagtgcacacaactccacagagtttctcatctacgaaagaggagtcgaggttggatgttggggcttgtgcatcaactccgtgttttcctcactttattcttactttcagaaagttttggtatcctacattggattaaagggtctttacttcacgggatatttgctgtttggcctggggacgggatttattgggctcttcccgaatgtctactccaccctggtcctgtgcagcctgtttggtgtaatgtccagcaccctgtacactgtgccctttaacctcattactgagtaccaccgcgaggaagaaaaggagaggcagcaggccccaggaggggacccagacaacagcgtgagagggaagggcatggactgcgccaccctcacatgcatggtgcagctggctcagatcctggtcggaggtggcctgggctttctggtcaacacagccgggaccgttgtcgtcgtggtgatcacagcgtctgcggtggcactgataggctgttgctttgtcgctctctttgttagatatgtggattaggtcaataaagagacaatgaccctaacctc

SEQ ID NO: 29266 - DNA, 989 bp, Homo sapiens
gccaggctccacgtcaaatccagtttgaaacacagaccctaggaccacgcaggaggtggtgggctcgcaggaaggttcctctcccagtggccatgggtagcaacagtgggcaggctggccgccacatctataaatccctagctgatgatggcccctttgactctgtggagccgcctaaaagacccaccagcagactcatcatgcacagcatggccatgttcggaagagagttctgctacgcggtggaggcagcgtatgtgaccccagtcctgctcagcgtaggtctgcccagcagcctgtacagcattgtgtggttcctcagccccatcctgggattcctgctgcagcccgtggtcggatcggccagcgaccactgccggtccaggtggggccgccggagaccctacatcctcaccctgggagtcatgatgctcgtgggcatggctctgtacctcaatggggctactgttgtagcagctttgattgctaacccaaggaggaagctggtttgggccataagtgtcaccatgataggtgtcgttctctttgattttgctgccgacttcattgatgggcccatcaaagcctacttatttgatgtctgctcccatcaggacaaggagaagggcctccactaccatgccctcttcacaggtactcgcagggcaatgacattaaagtcactgctgagagcactggtgaacatgcctcctcactaccgctacctttgcatcagccacctcattggatggacagccttcctgtccaacatgctgttcttcacagatttcatgggccagattgtgtaccgcggggatccctatagtgcacacaactccacagagtttctcatctacgaaagaggagtcgaggttggatgttggggcttgtgcatcaactccgtgttttcctcactttattcttgtaagtctttctctctcctaaggatgtcttctaaaagtttctggtctagcacaacttggatttga

SEQ ID NO: 29267 - DNA, 2723 bp, Homo sapiens
gaccctaggaccacgcaggaggtggtgggctcgcaggaaggttcctctcccagtggccatgggtagcaacagtgggcaggctggccgccacatctataaatccctagctgatgatggcccctttgactctgtggagccgcctaaaagacccaccagcagactcatcatgcacagcatggccatgttcggaagagagttctgctacgcggtggaggcagcgtatgtgaccccagtcctgctcagcgtaggtctgcccagcagcctgtacagcattgtgtggttcctcagccccatcctgggattcctgctgcagcccgtggtcggatcggccagcgaccactgccggtccaggtggggccgccggagaccctacatcctcaccctgggagtcatgatgctcgtgggcatggctctgtacctcaatggggctactgttgtagcagctttgattgctaacccaaggaggaagctggtttgggccataagtgtcaccatgataggtgtcgttctctttgattttgctgccgacttcattgatgggcccatcaaagcctacttatttgatgtctgctcccatcaggacaaggagaagggcctccactaccatgccctcttcacaggttttggaggtgccctgggttaccttttgggtgctatagactgggcccatctggagctgggaagactgttgggtacagaattccaggtcatgttcttcttctctgcattggtgctcactttgtgttttactgttcatctgtgcagtatctctgaagccccacttacagaggttgcaaagggcattcccccacagcaaacccctcaggaccctccattgtcatcagatggaatgtacgagtatggttctatcgagaaagttaaaaatggttacgtaaatccagagctggcaatgcagggagcaaaaaacaaaaatcatgctgaacagactcgcagggcaatgacattaaagtcactgctgagagcactggtgaacatgcctcctcactaccgctacctttgcatcagccacctcattggatggacagccttcctgtccaacatgctgttcttcacagatttcatgggccagattgtgtaccgcggggatccctatagtgcacacaactccacagagtttctcatctacgaaagaggagtcgaggttggatgttggggcttgtgcatcaactccgtgttttcctcactttattcttactttcagaaagttttggtatcctacattggattaaagggtctttacttcacgggatatttgctgtttggcctggggacgggatttattgggctcttcccgaatgtctactccaccctggtcctgtgcagcctgtttggtgtaatgtccagcaccctgtacactgtgccctttaacctcattactgagtaccaccgcgaggaagaaaaggaggtgtgctgtcattgaacctctgccttgggtaacatccagactcatctgaaggctggggaggatttggtagcaatgtgtagagcagagctggaaaataagggttcttgaaacagcaacagtcaaatgcccaaccaactgcaaccatgatctggtacaggcatgctcaccagcccagcccagcccagctgtcctgtcctccttattctcaactcctgctcacttagggagctgtagggcaagaagtgttactcccatttttctaattagaaaaaggcttggtgaggctgagaaaccagcccacaattacacaaagacaaaaaaagggggacccaggtcttctgtaaccacctcataggtctccctggtgccacctgcagcatttctagataccgacaataagggtctccctatccccaactttcagaggtacatagtggaatttcttggcattatttgctgagggtaggaaagtcctaggcaatggagtccagattttagtaagtcagaccccatgtgtgagaaggaaagctggaatcatgggtggtaatccccactttgctgccctgagcgggacctgtgccatttaaaccttggaacgcaactagtgaacaagcgcctatgcagtgcttataacagagttggtgtttccactctaaaattaccacctcttcttatcaaaatttgcaactttcttcctgtgaaaataggcttatagttccttaactggagcaatgatataaaagctacagagataactccaagtttaatccagctcagcatgaaactgcaaaaacactgaacatataaccatcagactataattctggccatgtttttcatcatttgatctggcagcagggcagaggtgcaccaggagtaaaaacctttcaaaaaagaggtgtggctttcctcatcccctggcaaacattgtcaccaaggtgggatgttgctgctaatgggagagtcatcataaaaaactgtccctacaaggagagtgttacatggtgttgggggaagaaaacctacgcttcaggctcagagaaacctggattcaaatcctgcctctctcacttggaagctgtgttacactggggatgttatttacttgtttattagttagcacttagaatgagttcatttttaggtgagataatatattcacaatgatacacaaaagtgcacactgtgtgctccctttaccatttactatctccctccagccccaacgtgttaccactcttactagttttttgttaatctttccggcatttttaaataaaaaccaagcaaatgtaaa

SEQ ID NO: 29268 - DNA, 1040 bp, Homo sapiens
acagaccctaggaccacgcaggaggtggtgggctcgcaggaaggttcctctcccagtggccatgggtagcaacagtgggcaggctggccgccacatctataaatccctagctgatgatggcccctttgactctgtggagccgcctaaaagacccaccagcagactcatcatgcacagcatggccatgttcggaagagagttctgctacgcggtggaggcagcgtatgtgaccccagtcctgctcagcgtaggtctgcccagcagcctgtacagcattgtgtggttcctcagccccatcctgggattcctgctgcagcccgtggtcggatcggccagcgaccactgccggtccaggtggggccgccggagaccctacatcctcaccctgggagtcatgatgctcgtgggcatggctctgtacctcaatggggctactgttgtagcagctttgattgctaacccaaggaggaagctggtttgggccataagtgtcaccatgataggtgtcgttctctttgattttgctgccgacttcattgatgggcccatcaaagcctacttatttgatgtctgctcccatcaggacaaggagaagggcctccactaccatgccctcttcacagactcgcagggcaatgacattaaagtcactgctgagagcactggtgaacatgcctcctcactaccgctacctttgcatcagccacctcattggatggacagccttcctgtccaacatgctgttcttcacagatttcatgggccagattgtgtaccgcggggatccctatagtgcacacaactccacagagtttctcatctacgaaagaggagtcgaggttggatgttggggcttgtgcatcaactccgtgttttcctcactttattcttgtaagtctttctctctcctaaggatgtcttctaaaagtttctggtctagcacaacttggatttgatatttctatgtgtatttcctactgtttaaaataccagattcttaataaatctatggacgtcaggaaaaactatcaccttaaaaa

SEQ ID NO: 29269 - DNA, 740 bp, Homo sapiens
gcatggctctgtacctcaatggggctactgttgtagcaggttttggaggtgccctgggttaccttttgggtgctatagactgggcccatctggagctgggaagactgttgggtacagaattccaggtcatgttcttcttctctgcattggtgctcactttgtgttttactgttcatctgtgcagtatctctgaagccccacttacagaggttgcaaagggcattcccccacagcaaacccctcaggaccctccattgtcatcagatggaatgtacgagtatggttctatcgagaaagttaaaaatggttacgtaaatccagagctggcaatgcagggagcaaaaaacaaaaatcatgctgaacagactcgcagggcaatgacattaaagtcactgctgagagcactggtgaacatgcctcctcactaccgctacctttgcatcagccacctcattggatggacagccttcctgtccaacatgctgttcttcacagatttcatgggccagattgtgtaccgcggggatccctatagtgcacacaactccacagagtttctcatctacgaaagaggagtcgaggttggatgttggggcttgtgcatcaactccgtgttttcctcactttattcttactttcagaaagttttggtatcctacattggattaaagggtctttacttcacgggatatttgctgtttggcctggggacgggatttattgggctcttcccgaatgtc

SEQ ID NO: 29270 - DNA, 3341 bp, Homo sapiens
aaggaagggggggcggaaccagcctgcacgcgctggctccgggtgacagccgcgcgcctcggccaggatctgagtgatgagacgtgtccccactgaggtgccccacagcagcaggtgttgagcatgggctgagaagctggaccggcaccaaagggctggcagaaatgggcgcctggctgattcctaggcagttggcggcagcaaggaggagaggccgcagcttctggagcagagccgagacgaagcagttctggagtgcctgaacggccccctgagccctacccgcctggcccactatggtccagaggctgtgggtgagccgcctgctgcggcaccggaaagcccagctcttgctggtcaacctgctaacctttggcctggaggtgtgtttggccgcaggcatcacctatgtgccgcctctgctgctggaagtgggggtagaggagaagttcatgaccatggtgctgggcattggtccagtgctgggcctggtctgtgtcccgctcctaggctcagccagtgaccactggcgtggacgctatggccgccgccggcccttcatctgggcactgtccttgggcatcctgctgagcctctttctcatcccaagggccggctggctagcagggctgctgtgcccggatcccaggcccctggagctggcactgctcatcctgggcgtggggctgctggacttctgtggccaggtgtgcttcactccactggaggccctgctctctgacctcttccgggacccggaccactgtcgccaggcctactctgtctatgccttcatgatcagtcttgggggctgcctgggctacctcctgcctgccattgactgggacaccagtgccctggccccctacctgggcacccaggaggagtgcctctttggcctgctcaccctcatcttcctcacctgcgtagcagccacactgctggtggctgaggaggcagcgctgggccccaccgagccagcagaagggctgtcggccccctccttgtcgccccactgctgtccatgccgggcccgcttggctttccggaacctgggcgccctgcttccccggctgcaccagctgtgctgccgcatgccccgcaccctgcgccggctcttcgtggctgagctgtgcagctggatggcactcatgaccttcacgctgttttacacggatttcgtgggcgaggggctgtaccagggcgtgcccagagctgagccgggcaccgaggcccggagacactatgatgaaggcgttcggatgggcagcctggggctgttcctgcagtgcgccatctccctggtcttctctctggtcatggaccggctggtgcagcgattcggcactcgagcagtctatttggccagtgtggcagctttccctgtggctgccggtgccacatgcctgtcccacagtgtggccgtggtgacagcttcagccgccctcaccgggttcaccttctcagccctgcagatcctgccctacacactggcctccctctaccaccgggagaagcaggtgttcctgcccaaataccgaggggacactggaggtgctagcagtgaggacagcctgatgaccagcttcctgccaggccctaagcctggagctcccttccctaatggacacgtgggtgctggaggcagtggcctgctcccacctccacccgcgctctgcggggcctctgcctgtgatgtctccgtacgtgtggtggtgggtgagcccaccgaggccagggtggttccgggccggggcatctgcctggacctcgccatcctggatagtgccttcctgctgtcccaggtggccccatccctgtttatgggctccattgtccagctcagccagtctgtcactgcctatatggtgtctgccgcaggcctgggtctggtcgccatttactttgctacacaggtagtatttgacaagagcgacttggccaaatactcagcgtagaaaacttccagcacattggggtggagggcctgcctcactgggtcccagctccccgctcctgttagccccatggggctgccgggctggccgccagtttctgttgctgccaaagtaatgtggctctctgctgccaccctgtgctgctgaggtgcgtagctgcacagctgggggctggggcgtccctctcctctctccccagtctctagggctgcctgactggaggccttccaagggggtttcagtctggacttatacagggaggccagaagggctccatgcactggaatgcggggactctgcaggtggattacccaggctcagggttaacagctagcctcctagttgagacacacctagagaagggtttttgggagctgaataaactcagtcacctggtttcccatctctaagccccttaacctgcagcttcgtttaatgtagctcttgcatgggagtttctaggatgaaacactcctccatgggatttgaacatatgaaagttatttgtaggggaagagtcctgaggggcaacacacaagaaccaggtcccctcagcccacagcactgtctttttgctgatccacccccctcttaccttttatcaggatgtggcctgttggtccttctgttgccatcacagagacacaggcatttaaatatttaacttatttatttaacaaagtagaagggaatccattgctagcttttctgtgttggtgtctaatatttgggtagggtgggggatccccaacaatcaggtcccctgagatagctggtcattgggctgatcattgccagaatcttcttctcctggggtctggccccccaaaatgcctaacccaggaccttggaaattctactcatcccaaatgataattccaaatgctgttacccaaggttagggtgttgaaggaaggtagagggtggggcttcaggtctcaacggcttccctaaccacccctcttctcttggcccagcctggttccccccacttccactcccctctactctctctaggactgggctgatgaaggcactgcccaaaatttcccctacccccaactttcccctacccccaactttccccaccagctccacaaccctgtttggagctactgcaggaccagaagcacaaagtgcggtttcccaagcctttgtccatctcagcccccagagtatatctgtgcttggggaatctcacacagaaactcaggagcaccccctgcctgagctaagggaggtcttatctctcagggggggtttaagtgccgtttgcaataatgtcgtcttatttatttagcggggtgaatattttatactgtaagtgagcaatcagagtataatgtttatggtgacaaaattaaaggctttcttatatgttta

SEQ ID NO: 29271 - DNA, 6400 bp, Homo sapiens
acagcgcaagccccacgccacgcgtcgctggtcccaggcagcgagtcgctcgcgcgccccgccgcccgcctggcgacagctccgccgcgcacgcacatggaggggagcgcgagccccccggaaaagccccgcgcccgccctgcggctgccgtgctgtgccggggcccggtagagccgctggtcttcctggccaactttgccttggtcctgcagggcccgctcaccacgcagtatctgtggcaccgcttcagcgccgacctcggctacaatggcacccgccaaagggggggctgcagcaaccgcagcgcggaccccaccatgcaggaagtggagacccttacctcccactggaccctctacatgaacgtgggcggcttcctggtggggctcttctcgtccaccctgctgggagcttggagcgacagtgtgggccgccgcccgctgctagtgctggcctcgctgggcctgctgctccaggccctagtgtccgtttttgtggtgcagctgcagctccacgtcggctacttcgtgctgggtcgcatcctttgtgccctcctcggcgacttcggtggccttctggctgctagctttgcgtccgtggcagatgtcagctccagtcgcagccgcaccttccggatggccctgctggaagccagcatcggggtggctgggatgctggcaagcctcctcgggggccactggctccgggcccagggttatgccaaccccttctggctggccttggccttgctgatagccatgactctctatgcagctttctgctttggtgagaccttaaaggagccaaagtccacccggctcttcacgttccgtcaccaccgatccattgtccagctctatgtggctcccgccccagagaagtccaggaaacatttagccctctactcactggccatcttcgtggtgatcactgtgcactttggggcccaggacatcttaaccctttatgaactaagcacacccctctgctgggactccaaactaatcggctatggttctgcagctcagcatctcccctacctcaccagcctgctggccctgaagctcctgcagtactgcctggccgatgcctgggtagctgagatcggcctggccttcaacatcctggggatggtggtctttgcctttgccactatcacgcctctcatgttcacaggtgctctcttttctgctgtggcctgtgtgaatagcctggccatgctgacggcctccggcttcaactcactctacccagccactctgaactttatgaaggggttccccttcctcctgggagctggcctcctgctcatcccggctgttctgattgggatgctggaaaaggctgatcctcacctcgagttccagcagtttccccagagcccctgatctgcctggaccagaagacagagggcaagaggagcaaagtgaacaccaagcaactggaggtctgcagctggaagcccagcccacagcaggacaagcaactcttgtctaagggcagtgctctctttggacgaggtagtcaagagagaccaaggcaccaccccatccacagctgacccagcctctgtctaggatctagaatcataacccacacaggcccactgcaggacaggtggcagaggagctatttgggacaggagtcagttctccctttctgctatccatcacttataaccccacaggccagaggagaggtcctgagagaggtgacacttcagggaccagaggcagcacgagggctggcatctctccttccagcccaaactgcacagccccaaccaggttcccaacacgtgtagcagtcatcagccattccttaacaatgaatgtggtacctggttagtgccagccttgggaaggagggagggaggtaagaggggcttggtgatctctggaggaagagtgttgcctttgctgtggttggggaatcgatccttggctatggcctacccactcccctggctgaagagtgccaatcattacaaatcagcttcagcaaactgaaacaaaccttctggtgccttgggctttggggccctctgttttcctgctcccagtctgcctgccatacgttagacaacagaagctgctgggctgggcaggagccctgagctgcctggtggattggtaccaagtggggccagccagggcttctactgactcgctgtgcaaccttgagcaagccccactaggaacggctagatcagcaatgccccaaattgttgaatcgtggtgatcacatttggatggacaagttaggaaacttagctgattctctgagatacttcccacttcctcatacattctacaatgagatgcctctcttcatgggcctggggaaaggatgaatgagtgtggctggacttttgacctttaatgtccctgagcagttcttggcccttggggagaagtagggggaggatctggctgactcagccccaaccgaggggtagcagctgcagcccagccaagcagaacaccctggccctacagacctgtgtctgagcaggctttggaggaaaggccacttctgagtcctctgtctcaggagaagccaggcctaggtgcttgacctggtgatctgagctgtgtttgtcctagtatgggtggcagtcacctctgaacacactggccttggcttagaggaggcttgtgacttcagctgttccagctggggctggatgctggactctgattccctcagagagacagaagatcgggcagaggtcaaccagaaggccacacagggcagtggacaacagtggagggtataccaaatagaaataaaacgcaggaaacctctctgaatactgcccttggggacctcaggagggagtgggactgattggagacaaagagccagaaatcatcccctggagatactcagacactgtattgttattggcgctgtcctgtgagggcagtgtccaggctgccctgcttgtcatatccatgccctggctctggccccggtgagcacttgtgctgcatgaggaaaggaggatcaggtggggtcaaaaccaaagcatcgaggctggcactggccaagacagactctggcagggaggggagtggaaggaaggagccccaaacctggagtgagacctttgactttctgatgatgtggccaagaactaggagtcacctggccagcacagccaagagtggggctgggggcgccagctttaaggtgtcaacacctggcccttgcggggaaagagccttcagcagcccccacggcctggagcctgggtttattggagggtgctttcttaccctctgaacccagtggaggagggggcaatgggatattcctgctctgtatggcctctgggtcagctttttgttgcaaaatcctatcccccgctgctagattctttgaagcaagggagaagcaatagcccagcctcagaatgattctcaggaaagcaattccactgccagtggactgggtgccaggaggcctaggtctggatctggggctgccactaatgacaggaaagtgggcttatcctcaacctttctgagcctcagtgtcattatctgtaaaatggggatgataataccaggtagagttgctctgatgactggagaccatggagcggagtgtttgggaaatggcaaagatttgtgagggcttcgtgctttagagatttgctacccttaaccaccagcatcagctcacctgggaatctgtaagaaatgcagagtcctaggccccaccccagatctcctgattttaacaacattcccaggtgacttggatgcatgttaaagttggagaagctgccctaagtgacaaccctttgccttttcaggactttgcctctttccacagagctgcaggttctgtctaggctgcttttactgccatgggggctgcctggtccctgagtaagcagtgggtagccctggatggctgaggggctggggaagccagctgggccagaccaggaaggagcctgaggcacagcaccaaggcatggggtagggtgggctttgaggcacggcctccccatgcccagacccaggcccaaacaggaggctcctgtgcaccagcaagtgcagcaaagctggctgcagtgacaaggaagtcagagggagggctggtttgcctcaaccctcgccctggatgtggcaaaagataccacaccgaaggaagctgtaggggatctgggacttagtcaggctagctaagggcactgagtgattacagggcaaggccacagagcggcaggaagttgtaagtgcaggggccaggcacagtctgagtggagagccatgatggcactcatccctggctggctcctgggcccaggcctttgctcagaatacagtgcccaggcccgcctgggcattgccttaattcctgtctgaggctgccttccttcatcctcctcaagctgactgctatcagcaggagaagggaatgcagaaccacccccaccccaactccagtgtctccagaactgagcagggaccctccccatgacggagacagacaacccaatggcagggcctgggggagttctaacctcccgtgcccaagcctgacttcccttccctctccagatactgaggaaagtgggttggaggtgggccatgagggtgggggacagggggagggagagccatttcctaagaagagcccaggttgtctcagcccagggagactggtttcaggagctgttccttcagaaaggacgatggaaatggaagtcacagcagggctggggaactggggactggttaggttggacccatgggtgcagcaccctccaaactggtgtcagagcctgcagatgagtcccgggaggagcggccctgcaggaagcggatgatcttctcaatggtggcctcctggtattcgtgggaccacctgtgggcacaggagccaatgtggttcagacagctgggcagagggagctgctagtcagctgtttgcccacactctgcctgtcatggtgatttgtaccctacccccctggtcccagggccctggggctcacttgataccgttgaaagtaagcacagcctgcatgtcctcaggcaggacctggggctcaggccactcgaagccatcaatgatgggcacaatgttcttgccgcagcttaaagcagtcacaatctcctggagaaagaaaggaaaggaggaagatacccctgtacccatctagggacccttgtagccaggcaggtgctgggaggcccactggcccgaggctgggcccagggcaggacaccagtcctgatgtccaccttgatgtctaccttaacccttgtagtgtaataaaaaataaatatttttcctttgcccagagttcctggcacagagctgctaaaacccttggaatctcttgagtgatgagtgtctttgtatgctaaagagatgattccccactgggggcccggggggtgctatgggggtagcctagatagtttcaggaagagggctggtcaccagggagaccagggcatgactagaggattggaactttcagccccacctcccagcctccagagaggtgctggagattgagttcaatcaccaatggccaatgatttaatcaatcatgcctacataatggaacctccataaaaacccccaaacaaggggttttgaagagcctccaggttgataaacaggtgtaggtgctgggaaggtggtagaaggcatggcatccacacctccaccctccatacgtagagatcctatgtatctcttccatttggctattcttgagctgtgtcctttataactgtgaaattaaataattcagctgggcatggtgggtcacgcctgtaatcccaacactttgggaggctgaggcaggaggatcacttgagcccaggattttgagattaataatattatttattactattattcaagctttgttaaatcaaacctaaagctcttggaactttaagttattctgagccttgacaggaattggtctctgcagcctgagtcatggggcatgcagctgcaacttccacctattttttttttttctgtaattacttaggaagaccaaatggcaccagagataagactcccttagatccccacttagatcaccaccctttctcagggggtaataaagtcatcttccttggaatgtagcaatctataaccaatcaaagcactgtaacatacgcactggtcttgtatggaaaatgttgtaatcctgctaaaattcctctctctttgcctgtggaagtgaaaccttaacttctccagtttggaatgctcaccccatgcctttggagtcaatgcttactgggtggctattctcaaactttgcactcaaagaaactctatacttagtcttattttctgaatctcattatttaaggttgacataataaacaactaatagtaagtaaagtg

SEQ ID NO: 29272 - DNA, 6487 bp, Homo sapiens
acagcgcaagccccacgccacgcgtcgctggtcccaggcagcgagtcgctcgcgcgccccgccgcccgcctggcgacagctccgccgcgcacgcacatggaggggagcgcgagccccccggaaaagccccgcgcccgccctgcggctgccgtgctgtgccggggcccggtagagccgctggtcttcctggccaactttgccttggtcctgcagggcccgctcaccacgcagtatctgtggcaccgcttcagcgccgacctcggctacaatggcacccgccaaagggggggctgcagcaaccgcagcgcggaccccaccatgcaggaagtggagacccttacctcccactggaccctctacatgaacgtgggcggcttcctggtggggctcttctcgtccaccctgctgggagcttggagcgacagtgtgggccgccgcccgctgctagtgctggcctcgctgggcctgctgctccaggccctagtgtccgtttttgtggtgcagctgcagctccacgtcggctacttcgtgctgggtcgcatcctttgtgccctcctcggcgacttcggtggccttctggctgctagctttgcgtccgtggcagatgtcagctccagtcgcagccgcaccttccggatggccctgctggaagccagcatcggggtggctgggatgctggcaagcctcctcgggggccactggctccgggcccagggttatgccaaccccttctggctggccttggccttgctgatagccatgactctctatgcagctttctgctttggtgagaccttaaaggagccaaagtccacccggctcttcacgttccgtcaccaccgatccattgtccagctctatgtggctcccgccccagagaagtccaggaaacatttagccctctactcactggccatcttcgtggtgatcactgtgcactttggggcccaggacatcttaaccctttatgaactaagcacacccctctgctgggactccaaactaatcggctatggttctgcagctcagcatctcccctacctcaccagcctgctggccctgaagctcctgcagtactgcctggccgatgcctgggtagctgagatcggcctggccttcaacatcctggggatggtggtctttgcctttgccactatcacgcctctcatgttcacaggatatgggttgcttttcctgtcattagtcatcacacctgtcatccgggctaaactctccaagctggtgagagagacagagcagggtgctctcttttctgctgtggcctgtgtgaatagcctggccatgctgacggcctccggcattttcaactcactctacccagccactctgaactttatgaaggggttccccttcctcctgggagctggcctcctgctcatcccggctgttctgattgggatgctggaaaaggctgatcctcacctcgagttccagcagtttccccagagcccctgatctgcctggaccagaagacagagggcaagaggagcaaagtgaacaccaagcaactggaggtctgcagctggaagcccagcccacagcaggacaagcaactcttgtctaagggcagtgctctctttggacgaggtagtcaagagagaccaaggcaccaccccatccacagctgacccagcctctgtctaggatctagaatcataacccacacaggcccactgcaggacaggtggcagaggagctatttgggacaggagtcagttctccctttctgctatccatcacttataaccccacaggccagaggagaggtcctgagagaggtgacacttcagggaccagaggcagcacgagggctggcatctctccttccagcccaaactgcacagccccaaccaggttcccaacacgtgtagcagtcatcagccattccttaacaatgaatgtggtacctggttagtgccagccttgggaaggagggagggaggtaagaggggcttggtgatctctggaggaagagtgttgcctttgctgtggttggggaatcgatccttggctatggcctacccactcccctggctgaagagtgccaatcattacaaatcagcttcagcaaactgaaacaaaccttctggtgccttgggctttggggccctctgttttcctgctcccagtctgcctgccatacgttagacaacagaagctgctgggctgggcaggagccctgagctgcctggtggattggtaccaagtggggccagccagggcttctactgactcgctgtgcaaccttgagcaagccccactaggaacggctagatcagcaatgccccaaattgttgaatcgtggtgatcacatttggatggacaagttaggaaacttagctgattctctgagatacttcccacttcctcatacattctacaatgagatgcctctcttcatgggcctggggaaaggatgaatgagtgtggctggacttttgacctttaatgtccctgagcagttcttggcccttggggagaagtagggggaggatctggctgactcagccccaaccgaggggtagcagctgcagcccagccaagcagaacaccctggccctacagacctgtgtctgagcaggctttggaggaaaggccacttctgagtcctctgtctcaggagaagccaggcctaggtgcttgacctggtgatctgagctgtgtttgtcctagtatgggtggcagtcacctctgaacacactggccttggcttagaggaggcttgtgacttcagctgttccagctggggctggatgctggactctgattccctcagagagacagaagatcgggcagaggtcaaccagaaggccacacagggcagtggacaacagtggagggtataccaaatagaaataaaacgcaggaaacctctctgaatactgcccttggggacctcaggagggagtgggactgattggagacaaagagccagaaatcatcccctggagatactcagacactgtattgttattggcgctgtcctgtgagggcagtgtccaggctgccctgcttgtcatatccatgccctggctctggccccggtgagcacttgtgctgcatgaggaaaggaggatcaggtggggtcaaaaccaaagcatcgaggctggcactggccaagacagactctggcagggaggggagtggaaggaaggagccccaaacctggagtgagacctttgactttctgatgatgtggccaagaactaggagtcacctggccagcacagccaagagtggggctgggggcgccagctttaaggtgtcaacacctggcccttgcggggaaagagccttcagcagcccccacggcctggagcctgggtttattggagggtgctttcttaccctctgaacccagtggaggagggggcaatgggatattcctgctctgtatggcctctgggtcagctttttgttgcaaaatcctatcccccgctgctagattctttgaagcaagggagaagcaatagcccagcctcagaatgattctcaggaaagcaattccactgccagtggactgggtgccaggaggcctaggtctggatctggggctgccactaatgacaggaaagtgggcttatcctcaacctttctgagcctcagtgtcattatctgtaaaatggggatgataataccaggtagagttgctctgatgactggagaccatggagcggagtgtttgggaaatggcaaagatttgtgagggcttcgtgctttagagatttgctacccttaaccaccagcatcagctcacctgggaatctgtaagaaatgcagagtcctaggccccaccccagatctcctgattttaacaacattcccaggtgacttggatgcatgttaaagttggagaagctgccctaagtgacaaccctttgccttttcaggactttgcctctttccacagagctgcaggttctgtctaggctgcttttactgccatgggggctgcctggtccctgagtaagcagtgggtagccctggatggctgaggggctggggaagccagctgggccagaccaggaaggagcctgaggcacagcaccaaggcatggggtagggtgggctttgaggcacggcctccccatgcccagacccaggcccaaacaggaggctcctgtgcaccagcaagtgcagcaaagctggctgcagtgacaaggaagtcagagggagggctggtttgcctcaaccctcgccctggatgtggcaaaagataccacaccgaaggaagctgtaggggatctgggacttagtcaggctagctaagggcactgagtgattacagggcaaggccacagagcggcaggaagttgtaagtgcaggggccaggcacagtctgagtggagagccatgatggcactcatccctggctggctcctgggcccaggcctttgctcagaatacagtgcccaggcccgcctgggcattgccttaattcctgtctgaggctgccttccttcatcctcctcaagctgactgctatcagcaggagaagggaatgcagaaccacccccaccccaactccagtgtctccagaactgagcagggaccctccccatgacggagacagacaacccaatggcagggcctgggggagttctaacctcccgtgcccaagcctgacttcccttccctctccagatactgaggaaagtgggttggaggtgggccatgagggtgggggacagggggagggagagccatttcctaagaagagcccaggttgtctcagcccagggagactggtttcaggagctgttccttcagaaaggacgatggaaatggaagtcacagcagggctggggaactggggactggttaggttggacccatgggtgcagcaccctccaaactggtgtcagagcctgcagatgagtcccgggaggagcggccctgcaggaagcggatgatcttctcaatggtggcctcctggtattcgtgggaccacctgtgggcacaggagccaatgtggttcagacagctgggcagagggagctgctagtcagctgtttgcccacactctgcctgtcatggtgatttgtaccctacccccctggtcccagggccctggggctcacttgataccgttgaaagtaagcacagcctgcatgtcctcaggcaggacctggggctcaggccactcgaagccatcaatgatgggcacaatgttcttgccgcagcttaaagcagtcacaatctcctggagaaagaaaggaaaggaggaagatacccctgtacccatctagggacccttgtagccaggcaggtgctgggaggcccactggcccgaggctgggcccagggcaggacaccagtcctgatgtccaccttgatgtctaccttaacccttgtagtgtaataaaaaataaatatttttcctttgcccagagttcctggcacagagctgctaaaacccttggaatctcttgagtgatgagtgtctttgtatgctaaagagatgattccccactgggggcccggggggtgctatgggggtagcctagatagtttcaggaagagggctggtcaccagggagaccagggcatgactagaggattggaactttcagccccacctcccagcctccagagaggtgctggagattgagttcaatcaccaatggccaatgatttaatcaatcatgcctacataatggaacctccataaaaacccccaaacaaggggttttgaagagcctccaggttgataaacaggtgtaggtgctgggaaggtggtagaaggcatggcatccacacctccaccctccatacgtagagatcctatgtatctcttccatttggctattcttgagctgtgtcctttataactgtgaaattaaataattcagctgggcatggtgggtcacgcctgtaatcccaacactttgggaggctgaggcaggaggatcacttgagcccaggattttgagattaataatattatttattactattattcaagctttgttaaatcaaacctaaagctcttggaactttaagttattctgagccttgacaggaattggtctctgcagcctgagtcatggggcatgcagctgcaacttccacctattttttttttttctgtaattacttaggaagaccaaatggcaccagagataagactcccttagatccccacttagatcaccaccctttctcagggggtaataaagtcatcttccttggaatgtagcaatctataaccaatcaaagcactgtaacatacgcactggtcttgtatggaaaatgttgtaatcctgctaaaattcctctctctttgcctgtggaagtgaaaccttaacttctccagtttggaatgctcaccccatgcctttggagtcaatgcttactgggtggctattctcaaactttgcactcaaagaaactctatacttagtcttattttctgaatctcattatttaaggttgacataataaacaactaatagtaagtaaagtg

SEQ ID NO: 29273 - DNA, 2502 bp, Homo sapiens
ctcgggaggtcactcggctgctgggcgggctgctgtcacaggcgctgcgtgccctggctctgctcgccactggccggcgcgctcccggcgcacggagcacactcgcgctcccggcgcacggagcacactcgcgctccgggactgaaacctgagcagccgtagcagccgaatttgggagcatatccttgtcactgcagccagaaagcccttcgatccccatcagagaggtcacatgagccccgaggtcacctgcccgcggaggggccacctgcctcgcttccacccgaggacctgggttgagcccgtggtggcctcgtcccaggtggctgcctccctctacgatgcggggctactcctcgtggtgaaggcgtcctacggaaccggaggctcctccaaccacagtgccagcccatcgccccggggggctctagaggaccaacagcagagagccatctccaatttctacattatctacaaccttgtggtgggcctgtcccccctgctgtccgcctacgggctgggatggctcagcgaccgctaccaccgaaagatctccatctgcatgtcgctgctgggcttcctgctctcccgcctcgggctgctgctcaaggtgctgctggactggccagtggaggtgctgtacggggcggcggcgctgaacgggctattcggcggcttctccgccttctggtccggggtcatggcgctgggatcgctgggctcctccgagggccgccgctctgtgcgcctcatcctcattgacctgatgctgggcttggcggggttctgcgggagcatggcttccgggcatctcttcaagcagatggctgggcactctgggcagggcctgatactgacggcctgcagcgtgagctgtgcctcgtttgccctgctctacagccttttggtgctaaaggtccctgagtcggtggccaaacccagccaggagctccccgccgtggataccgtgtctggcacggttggcacataccgcactctggatcctgatcagttggaccaacagtatgcagtggggcaccctccatctcctggaaaagcaaaaccccataaaaccaccattgccttgctctttgtgggtgctatcatatatgacctggcggtggtgggcacagtggacgtgatccctctttttgtgctgagggagcctctcggttggaaccaagtgcaggtgggctatggtatggctgcagggtacaccatcttcatcaccagcttcctgggtgtcctggtcttctcccgctgctttcgggacaccaccatgatcatgattgggatggtctcctttgggtcaggagccctcctcttggcttttgtgaaagagacatacatgttctatattgctcgagccgtcatgctgtttgctctcatccccgtcacaaccatccgatcagctatgtccaaactcataaagggctcctcttatggaaaggtgttcgtcatactgcagctgtccttggctctgaccggcgtggtgacatccaccttgtacaacaagatctaccagctcaccatggacatgtttgtgggctcctgctttgctctctcctcctttctctccttcctggccatcattccaattagcatcgtggcctataaacaagtcccattgtcaccatatggagacatcatagagaaatgaagatgcttacctgcaggaactgaaaacatcagccatggccaggcccccagaagacaaaagaagggaccagggaactggtgacctaagcaacccactgcttaagaaacctgcgttccagccagagttggcctcagaatgacctgctctggctcagggatccctggtggatggggaaaagcactttcctggtgatggaaaaacgttctcagctttaagacacccccattaggcagacactgggttctgtgacagcagagcatgaccttaagggttacaggcaggctgcacacagcagtcccaggccctgtgaggggcttcagactccagctacagcgagcctgccccttttcttcaagggactgtcttgagggctccaaagtatagctaactagtcacctgggtgctgtgctgaaagtcccatgggagaactcaaagcgtgcattatcacagcctgaggggaatgtggaagggatgttttgtaagaactaccaacagttttgcacgaacaatgtcttttaaattaaaataaaaccttgaaaaaagtcagctttctttcctgagtcttccttacctacaaacactcaggagggggatggagctcaggcccttgtcttctgggtagttttgttactactgttgcttttaagaagcaaatgtcacaaggctttcttcaatgggatgttcaattgagtacttccagtcaacagtgcttcccaaagtgggtggtgtgaaggaagaggaggtacattaagagctattttatttgaggtagtcatttttataaccttgtttacttggatttataaaagcagactcacctaataaaatcaacattcattgta

SEQ ID NO: 29274 - DNA, 3280 bp, Homo sapiens
actgccggcctgcgcggtactcactgccggcctccgcggtacccactgccggcctccgcgctacccggccgcagcgcgcgagtcacatggaagctcctgaggagcccgcgccagtgcgcggaggcccggaggccacccttgaggtccgtgggtcgcgctgcttgcggctgtccgccttccgagaagagctgcgggcgctcttggtcctggctggccccgcgttcttggttcagctgatggtgttcctgatcagcttcataagctccgtgttctgtggccacctgggcaagctggagctggatgcagtcacgctggcaatcgcggttatcaatgtcactggtgtctcagtgggattcggcttatcttctgcctgtgacaccctcatctcccagacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgcaacctttctttatatgttacaagttaaatatttgctcaaccagggaattgtactgccccagatcgtaactggagttgcagccaaccttgtcaatgccctcgccaactatctgtttctccatcaactgcatcttggggtgataggctctgcactggcaaacttgatttcccagtacaccctggctctactcctctttctctacatcctcgggaaaaaactgcatcaagctacatggggaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccctgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatgggtctgtggtcagggatcatcatctgtacagtctttcaagctgtgtgttttctaggctttattattcagctaaattggaaaaaagcctgtcagcaggctcaggtacacgccaatttgaaagtaaacaacgtgcctcggagtgggaattctgctctccctcaggatccgcttcacccagggtgccctgaaaaccttgaaggaattttaacgaacgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctggtggggattttagtgagattctatgtcagaattcagtgacgtggtaggaaagaaagtcaggtcaagtgatgcttttgagcttacacacaattcacaggcccaccagtgacaatttactgtgagttaatgtcattcaggtgtgcccatggattttgagggctggaaatgcaaagacacatttttctataaaaagaaaaagcaactaaggttaaaagctatattgtggcccaagacactgtctgaaagatgacatgagtagtaattcaccactatctgaaccaagcaaggatcaatgtgctgactgcattggccaatggctttgatacttctgctatttttttagacacaaacccataaactaactgcttaagaattcatactgcttgaattatgtaaaatatattttacagtatatctttccttgggccttagattactattcactgggcaaatggtatttgtttttgttttaattttttttttaatagacggaagtcttgctctgtcatgcaggctggagtgcggtggtgcgatcatagctcactgcagcctcgaactcttgggcttcaagcaatcctcctgtgtcagccaccagagtagctgagactacaggggtatgccaccatgcccagctggcatttgttaatcttcatttgaggtctagatctaggcactgtggacactgaaaaacagttgggaaatctttcgagctgtggaaatccaaacaaagactgataattcctggtaggggtgtgtgcgtgacgtactgcagcctcaacctcctgggctcaagtgatcctcccacctcagcctcctgagtagctgagaccacaggcgtgtgccaccacgcctagctaattttttataccagggtctaccctttgtttcccaggctggtcttgaattcctgggatcaagcaatccttccaccttgccctcccaaagtgttgggattataggcatgagccaccacgactggccagaggacaaaattttaataaaggtcttagcttaagcagtaatcctacttcattaagccttcctggggtgcggtacacaccgttaattcagcaaccctcagtacatactaagtatgctcagtgctgtgaaagtggattacaccaaattaagtcattcttatcacacccaatcaaaagtcaagaagccagggataaaagcacctcaggcacataacattaatctagtaatgtaattctctgcacatccagctggtgaaactgcgtgctgtaagctgggaccagctttgtccataactgctgagagaacttgctgaagctctaggaataattttgcctgcccggttgctcaccagttgtagcttgccagctcccaacacccttcctggtgccaataaactttctcaaagagcaatactgacatttcttttgataaaacctccagccttctctgtgttgttccgacataccgaggaccaactggtctacatggatgccctgaacatgcaattctttcttccaaaataaaacattaaatagaga

SEQ ID NO: 29275 - DNA, 1998 bp, Homo sapiens
ccggcctccgcggtacccactgccggcctccgcgctacccggccgcagcgcgcgagtcacatggaagctcctgaggagcccgcgccagtgcgcggaggcccggaggccacccttgaggtccgtgggtcgcgctgcttgcggctgtccgccttccgagaagagctgcgggcgctcttggtcctggctggccccgcgttcttggttcagctgatggtgttcctgatcagcttcataagctccgtgttctgtggccacctgggcaagctggagctggatgcagtcacgctggcaatcgcggttatcaatgtcactggtgtctcagtgggattcggcttatcttctgcctgtgacaccctcatctcccagacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgcaacctttctttatatgttacaagttaaatatttgctcaaccagggaattgtactgccccagatcgtaactggagttgcagccaaccttgtcaatgccctcgccaactatctgtttctccatcaactgcatcttggggtgataggctctgcactggcaaacttgatttcccagtacaccctggctctactcctctttctctacatcctcgggaaaaaactgcatcaagctacatggggaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccctgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatgggtctgtggtcagggatcatcatctgtacagtctttcaagctgtgtgttttctaggctttattattcagctaaattggaaaaaagcctgtcagcaggctcaggtacacgccaatttgaaagtaaacaacgtgcctcggagtgggaattctgctctccctcaggatccgcttcacccagggtgccctgaaaaccttgaaggaattttaacgaacgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctggctggagtgcggtggtgcgatcatagctcactgcagcctcgaactcttgggcttcaagcaatcctcctgtgtcagccaccagagtagctgagactacagggctggtgaaactgcgtgctgtaagctgggaccagctttgtccataactgctgagagaacttgctgaagctctaggaataattttgcctgcccggttgctcaccagttgtagcttgccagctcccaacacccttcctggtgccaataaactttctcaaagagcaa

SEQ ID NO: 29276 - DNA, 1362 bp, Homo sapiens
attgggactgttctttccagaggctctgcactggcaaacttgatttcccagtacaccctggctctactcctctttctctacatcctcgggaaaaaactgcatcaagctacatggggaggcatcctcggcatggtggagctgggcgctcagtccatcgtgtatgaactggccatcattgtgtacatggtccctgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatgggtctgtggtcagggatcatcatctgtacagtctttcaagctgtgtgttttctaggctttattattcagctaaattggaaaaaagcctgtcagcaggctcaggtacacgccaatttgaaagtaaacaacgtgcctcggagtgggaattctgctctccctcaggatccgcttcacccagggtgccctgaaaaccttgaaggaattttaacgaacgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctggtggggattttagtgagattctatgtcagaattcagtgacgtggtaggaaagaaagtcaggtcaagtgatgcttttgagcttacacacaattcacaggcccaccagtgacaatttactgtgagttaatgtcattcaggtgtgcccatggattttgagggctggaaatgcaaagacacatttttctataaaaagaaaaagcaactaaggttaaaagctatattgtggcccaagacactgtctgaaagatgacatgagtagtaattcaccactatctgaaccaagcaaggatcaatgtgctgactgcattggccaatggctttgatacttctgctatttttttagacacaaacccataaactaactgcttaagaattcatactgcttgaattatgtaaaatatattttacagtatatctttcctt

SEQ ID NO: 29277 - DNA, 1719 bp, Homo sapiens
agagcaggctgcactgcgcggtacccactgccggcctgcgcggtactcactgccggcctccgcggtacccactgccggcctccgcgctacccggccgcagcgcgcgagtcacatggaagctcctgaggagcccgcgccagtgcgcggaggcccggaggccacccttgaggtccgtgggtcgcgctgcttgcggctgtccgccttccgagaagagctgcgggcgctcttggtcctggctggccccgcgttcttggttcagctgatggtgttcctgatcagcttcataagctccgtgttctgtggccacctgggcaagctggagctggatgcagtcacgctggcaatcgcgacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgcaacctttctttatatgttacaagttaaatatttgctcaaccagggaattgtactgccccagatcgtaactggagttgcagccaaccttgtcaatgccctcgccaactatctgtttctccatcaactgcatcttggggtgataggctctgcactggcaaacttgatttcccagtacaccctggctctactcctctttctctacatcctcgggaaaaaactgcatcaagctacatggggaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccctgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatgggctcaggtacacgccaatttgaaagtaaacaacgtgcctcggagtgggaattctgctctccctcaggatccgcttcacccagggtgccctgaaaaccttgaaggaattttaacgaacgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctggtggggattttagtgagattctatgtcagaattcagtgacgtggtaggaaagaaagtcaggtcaagtgatgcttttgagcttacacacaattcacag

SEQ ID NO: 29278 - DNA, 1002 bp, Homo sapiens
attgggactgttctttccagaggctctgcactggcaaacttgatttcccagtacaccctggctctactcctctttctctacatcctcgggaaaaaactgcatcaagctacatggggaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccctgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatggggtgccctgaaaaccttgaaggaattttaacgaacgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctggtggggattttagtgagattctatgtcagaattcagtgacgtggtaggaaagaaagtcaggtcaagtgatgcttttgagcttacacacaattcacaggcccaccagtgacaatttactgtgagtta

SEQ ID NO: 29279 - DNA, 1847 bp, Homo sapiens
actgccggcctgcgcggtactcactgccggcctccgcggtacccactgccggcctccgcgctacccggccgcagcgcgcgagtcacatggaagctcctgaggagcccgcgccagtgcgcggaggcccggaggccacccttgaggtccgtgggtcgcgctgcttgcggctgtccgccttccgagaagagctgcgggcgctcttggtcctggctggccccgcgttcttggttcagctgatggtgttcctgatcagcttcataagctccgtgttctgtggccacctgggcaagctggagctggatgcagtcacgctggcaatcgcggttatcaatgtcactggtgtctcagtgggattcggcttatcttctgcctgtgacaccctcatctcccagacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgcaacctttctttatatgttacaagttaaatatttgctcaaccagggaattgtactgccccagatcgtaactggagttgcagccaaccttgtcaatgccctcgccaactatctgtttctccatcaactgcatcttggggtgataggctctgcactggcaaacttgatttcccagtacaccctggctctactcctctttctctacatcctcgggaaaaaactgcatcaagctacatggggaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccctgcaggcttcagtgtggctgccagtgtccgggtaggaaacgctctgggtgctggagacatggagcaggcacggaagtcctctaccgtttccctgctgattacagtgctctttgctgtagccttcagtgtcctgctgttaagctgtaaggatcacgtggggtacatttttactaccgaccgagacatcattaatctggtggctcaggtggttccaatttatgctgtttcccacctctttgaagctcttgcttgcacgagtggtggtgttctgagggggagtggaaatcagaaggttggagccattgtgaataccattgggtactatgtggttggcctccccatcgggatcgcgctgatgtttgcaaccacacttggagtgatgggtctgtggtcagggatcatcatctgtacagtctttcaagctgtgtgttttctaggctttattattcagctaaattggaaaaaagcctgtcagcaggctcaggtacacgccaatttgaaagtaaacaacgtgcctcggagtgggaattctgctctccctcaggatccgcttcacccagggtgccctgaaaaccttgaaggaattttaacgaacgatgttggaaagacaggcgagcctcagtcagatcagcagatgcgccaagaagaacctttgccggaacatccacaggacggcgctaaattgtccaggaaacagctggtgctgcggcgagggcttctgctcctgggggtcttcttaatcttgctggctggagtgcggtggtgcgatcatagctcactgcagcctcgaactcttgggcttcaagcaatcctcctgtgtcagccaccagagtag

SEQ ID NO: 29280 - DNA, 974 bp, Homo sapiens
actgccggcctgcgcggtactcactgccggcctccgcggtacccactgccggcctccgcgctacccggccgcagcgcgcgagtcacatggaagctcctgaggagcccgcgccagtgcgcggaggcccggaggccacccttgaggtccgtgggtcgcgctgcttgcggctgtccgccttccgagaagagctgcgggcgctcttggtcctggctggccccgcgttcttggttcagctgatggtgttcctgatcagcttcataagctccgtgttctgtggccacctgggcaagctggagctggatgcagtcacgctggcaatcgcggttatcaatgtcactggtgtctcagtgggattcggcttatcttctgcctgtgacaccctcatctcccagacgtacgggagccagaacctgaagcacgtgggcgtgatcctgcagcggagtgcgctcgtcctgctcctctgctgcttcccctgctgggcgctctttctcaacacccagcacatcctgctgctcttcaggcaggacccagatgtgtccaggcttacccagacctatgtcacgatcttcattccagctcttcctgcaacctttctttatatgttacaagttaaatatttgctcaaccagaggctctgcactggcaaacttgatttcccagtacaccctggctctactcctctttctctacatcctcgggaaaaaactgcatcaagctacatggggaggctggtccctcgagtgcctgcaggactgggcctccttcctccgcctggccatccccagcatgctcatgctgtgcatggagtggtgggcctatgaggtcgggagcttcctcagtggcatcctcggcatggtggagctgggcgctcagtccatcgtgtatgaactggccatcattgtgtacatggtccctgcaggcttcagtgtggctgccagtgtccgggtaggaaacgctctgggtgctggagacat

SEQ ID NO: 29281 - DNA, 2231 bp, Homo sapiens
ctggccgtgcaggcgctcaggcgtgcagggtagccagtgccccggccaggaatggacagcctccaggacacagtggccctggaccatgggggctgctgccctgccctcagcaggctggttcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggcctttgtcaatgtctgcggagtttctgtaggagttggtttgtcttcggcatgtgacaccttgatgtctcagagcttcggcagccccaacaagaagcacgtgggcgtgatcctgcagcggggcgcgctggtcctgctcctctgctgcctcccttgctgggcgctcttcctcaacacccagcacatcctgctgctcttccggcaggacccggacgtgtccaggttgacccaggactatgtaatgattttcattccaggacttccggtgatttttctttacaatctgctggcaaaatatttgcaaaatcagggatggctgaaggggcaggaggaggagtccccattccaaaccccgggtttgtccatcctccatccatctcactcacaccttagcagggccagttttcatttatttcagaagatcacctggccccaagtcctcagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcacctggagacgtgggcaggttggtccagccagtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatgattcccttggggctcagcatcggggtctgtgtccgagtggggatggctctgggggctgcggatactgtgcaggccaagcgctcggccgtctcgggcgtgctcagcatagttggcatttccctggtcctgggcaccctgataagcatcctgaaaaatcagctggggcatatttttaccaatgatgaagatgtcattgccctggtgagccaggtcttgccggtttatagtgtctttcacgtgtttgaggccatctgttgtgtctatggcggagttctgagaggaactgggaagcaggcctttggtgccgctgtgaatgccatcacatattacatcatcggcctaccactgggcatccttctgacctttgtggtcagaatgagaatcatgggcctctggctgggcatgctggcctgtgtcttcctggcaactgctgcctttgttgcttatactgcccggctggactggaagcttgctgcagaggaggctaagaaacattcaggccggcagcagcagcagagagcagagagcactgcaaccagacctgggcctgagaaagcagtcctatcttcagtggctacaggcagttcccctggcattaccttgacaacgtattcaaggtctgagtgccacgtggacttcttcaggactccagaggaggcccacgccctttcagctcctaccagcagactatcagtgaaacagctggtcatccgccgtggggctgctctgggggcggcgtcagccacactgatggtggggctcacggtcaggatcctagccaccaggcactagcaaagaagcttggaaatagaaagccaggagtggctgtccccagtatgcaaacacaccacggtctgccctgcaaaaacaccaatggggtctagtgcaggtggacactttgaaccactcctcaaaaaaagaactttggctgattccttgtggtgacactcagaggggtctgaacagacttgacaattctgttctggtcaagctggagttttcttctgtgacttggactgctctacagaagacatcagccaactgcacgagtcagagtccagggattgtcactattattaataatgtaaatggcttcaaatgggacactgcagataaaatcacaaaaaccactgttatattaaagattacacatttcctgggca

SEQ ID NO: 29282 - DNA, 2181 bp, Homo sapiens
ggctcgctggacaaagctggccgtgcaggcgctcaggcgtgcagggtagccagtgccccggccaggaatggacagcctccaggacacagtggccctggaccatgggggctgctgccctgccctcagcaggctggttcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggcctttgtcaatgtctgcggagtttctgtaggagttggtttgtcttcggcatgtgacaccttgatgtctcagagcttcggcagccccaacaagaagcacgtgggcgtgatcctgcagcggggcgcgctggtcctgctcctctgctgcctcccttgctgggcgctcttcctcaacacccagcacatcctgctgctcttccggcaggacccggacgtgtccaggttgacccaggactatgtaatgattttcattccaggacttccggtgatttttctttacaatctgctggcaaaatatttgcaaaatcagaagatcacctggccccaagtcctcagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcacctggagacgtgggcaggttggtccagccagtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatgagacacagccatcgtcttgcttatgcagcccatgtcactcggattcccttggggctcagcatcggggtctgtgtccgagtggggatggctctgggggctgcggatactgtgcaggccaagcgctcggccgtctcgggcgtgctcagcatagttggcatttccctggtcctgggcaccctgataagcatcctgaaaaatcagctggggcatatttttaccaatgatgaagatgtcattgccctggtgagccaggtcttgccggtttatagtgtctttcacgtgtttgaggccatctgttgtgtctatggcggagttctgagaggaactgggaagcaggcctttggtgccgctgtgaatgccatcacatattacatcatcggcctaccactgggcatccttctgacctttgtggtcagaatgagaatcatgggcctctggctgggcatgctggcctgtgtcttcctggcaactgctgcctttgttgcttatactgcccggctggactggaagcttgctgcagaggaggctaagaaacattcaggccggcagcagcagcagagagcagagagcactgcaaccagacctgggcctgagaaagcagtcctatcttcagtggctacaggcagttcccctggcattaccttgacaacgtattcaaggtctgagtgccacgtggacttcttcaggactccagaggaggcccacgccctttcagctcctaccagcagactatcagtgaaacagctggtcatccgccgtggggctgctctgggggcggcgtcagccacactgatggtggggctcacggtcaggatcctagccaccaggcactagcaaagaagcttggaaatagaaagccaggagtggctgtccccagtatgcaaacacaccacggtctgccctgcaaaaacaccaatggggtctagtgcaggtggacactttgaaccactcctcaaaaaaagaactttggctgattccttgtggtgacactcagaggggtctgaacagacttgacaattctgttctggtcaagctggagttttcttctgtgacttggactgctctacagaagacatcagccaactgcacgagtcagagtccagggattgtcactattattaataatgtaaatggcttcaaatgggacactgcagataaaatcacaaaaaccactgttatattaaagattacacatttcctgggca

SEQ ID NO: 29283 - DNA, 1100 bp, Homo sapiens
cccggccaggaatggacagcctccaggacacagtggccctggaccatgggggctgctgccctgccctcagcaggctggttcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggcctttgtcaatgtctgcggagtttctgtaggagttggtttgtcttcggcatgtgacaccttgatgtctcagagcttcggcagccccaacaagaagcacgtgggcgtgatcctgcagcggggcgcgctggtcctgctcctctgctgcctcccttgctgggcgctcttcctcaacacccagcacatcctgctgctcttccggcaggacccggacgtgtccaggttgacccaggactatgtaatgattttcattccaggacttccggtgatttttctttacaatctgctggcaaaatatttgcaaaatcagaagatcacctggccccaagtcctcagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcacctggagacgtgggcaggttggtccagccagtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatgattcccttggggctcagcatcggggtctgtgtccgagtggggatggctctgggggctgcggatactgtgcaggccaagcgctcggccgtctcgggcgtgctcagcatagttggcatttccctggtcctgggcaccctgataagcatcctgaaaaatcagctggggcatatttttaccaat

SEQ ID NO: 29284 - DNA, 1213 bp, Homo sapiens
agtgccctaggaggcagggctcatcccacaagttgccatggtagcccctcctcctgccccttactcatcagccaggctgtaccgacacgggctgcccaggcagggggtggctcgctggacaaagctggccgtgcaggcgctcaggcgtgcagggtagccagtgccccggccaggaatggacagcctccaggacacagtggccctggaccatgggggctgctgccctgccctcagcaggctggttcccagaggctttgggactgagatgtggactctctttgccctttctggacccctgttcctgttccaggtgctgacttttatgatctacatcgtgagcactgtgttctgcgggcacctgggcaaggtggagctggcatcggtgaccctcgcggtggcctttgtcaatgtctgcggagtttctgtaggagttggtttgtcttcggcatgtgacaccttgatgtctcagagcttcggcagccccaacaagaagcacgtgggcgtgatcctgcagcggggcgcgctggtcctgctcctctgctgcctcccttgctgggcgctcttcctcaacacccagcacatcctgctgctcttccggcaggacccggacgtgtccaggttgacccaggactatgtaatgattttcattccaggacttccggtgatttttctttacaatctgctggcaaaatatttgcaaaatcagaagatcacctggccccaagtcctcagtggtgtggtgggcaactgtgtcaacggtgtggccaactatgccctggtttctgtgctgaacctgggggtcaggggctccgcctatgccaacatcatctcccagtttgcacagaccgtcttcctccttctctacattgtgctgaagaagctgcacctggagacgtgggcaggttggtccagccagtgcctgcaggactggggccccttcttctccctggctgtccccagcatgctcatgatctgtgttgagtggtgggcctatgagatcgggagcttcctcatggggctgctcagtgtggtggatctctctgcccaggctgtcatctacgaggtggccactgtgacctacatgattcccttggggctcagcatcggggtctgtgtccgagtggggatggctctgggggctgcggatactgtgcaggccaagcgctcggccgtctcgggcgtgctcagcatagcaagatcagatccttggtaa

SEQ ID NO: 29285 - DNA, 3575 bp, Homo sapiens
gctgtcagcgctgagcacagcgcccagggagagggacagacagccggctgcatgggacagcggaacccagagtgagaggggaggtggcaggacagacagacagcaggggcggacgcagagacagacagcggggacagggaggccgacacggacatcgacagcccatagattcctaacccagggagccccggcccctctcgccgcttcccaccccagacggagcggggacaggctgccgagcatcctcccacccgccctccccgtcctgcctcctcggcccctgccagcttcccccgcttgagcacgcagggcgtccgaggacgcgctgggcctccgcacccgccctcatggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgagtacctggagatgcgcttcagccgcgcagtgcggctctgcgggactttgcagtacattgtagccacgatgctgtacaccggcatcgtaatctacgcaccggccctcatcctgaaccaagtgaccgggctggacatctgggcgtcgctcctgtccaccggaattatctgcaccttctacacggctgtgggcggcatgaaggctgtggtctggactgatgtgttccaggtcgtggtgatgctaagtggcttctgggttgtcctggcacgcggtgtcatgcttgtgggcgggccccgccaggtgctcacgctggcccagaaccactcccggatcaacctcatggactttaaccctgacccgaggagccgctatacattctggacttttgtggtgggtggcacgttggtgtggctctccatgtatggcgtgaaccaggcgcaggtgcagcgctacgtggcttgccgcacagagaagcaggccaagctggccctgctcatcaaccaggtcggcctgttcctgatcgtgtccagcgctgcctgctgtggcatcgtcatgtttgtgttctacactgactgcgaccctctcctcctggggcgcatctctgccccagaccagtacatgcctctgctggtgctggacatcttcgaagatctgcctggagtccccgggcttttcctggcctgtgcttacagtggcaccctcagcacagcatccaccagcatcaatgctatggctgcagtcactgtagaagacctcatcaaacctcggctgcggagcctggcacccaggaaactcgtgattatctccaaggggctctcactcatctacggatcggcctgtctcaccgtggcagccctgtcctcactgctcggaggaggtgtccttcagggctccttcaccgtcatgggagtcatcagcggccccctgctgggagccttcatcttgggaatgttcctgccggcctgcaacacaccgggcgtcctcgcgggactaggcgcgggcttggcgctgtcgctgtgggtggccttgggcgccacgctgtacccacccagcgagcagaccatgagggtcctgccatcgtcggctgcccgctgcgtggctctctcagtcaacgcctctggcctcctggacccggctctcctccctgctaacgactccagcagggcccccagctcaggaatggacgccagccgacccgccttagctgacagcttctatgccatctcctatctctattacggtgccctgggcacgctgaccactgtgctgtgcggagccctcatcagctgcctgacaggccccaccaagcgcagcaccctggccccgggattgttgtggtgggacctcgcacggcagacagcatcagtggcccccaaggaagaagtggccatcctggatgacaacttggtcaagggtcctgaagaactccccactggaaacaagaagccccctggcttcctgcccaccaatgaggatcgtctgtttttcttggggcagaaggagctggagggggctggctcttggaccccctgtgttggacatgatggtggtcgagaccagcaggagacaaacctctgaggacagggccagccgcgggactgacaccctgggatggaacctcaggatgggccaaacccagacaacgggcccatggccttgggctctgattggctggattgccttgtatgcaaatgagttcaggactacaataccctaccctatggggaggccctgcctccgggaggtcattttttaaatccagccccttgcttcaaccgtccccagtattagacgctgcagccctgacggctccccccaaataaggctgggtttttctctctctcttttttttttttttttttttttgagacagggtcatgctctgtcacccaggctggagtgcagtggtgtgatctcggctcactgcaacctctgcctcccaggctcaagtgattctcctgcctcagcctcttgagtagctgggattgtaggtgcccaccaccatgcccagccaactttttgtatttttagtagagacagggtttcaccatgttggtcaggctggtctcgaactcctgacctcaagtgatccacctgcctcggcctcccaaagtgctgggttacaggcgtaagctaccatgcccagcctaccgtttttctcaatctataatagaaagccaccacgcccaggtaatttttgtaattttgtatttttgtagagacggggttttgccatgttggccaggctggtctcaaactcctgatctcaggtgatcctcctgccttggcctcccaaagggctgggattacaggggtgagccaccgcgccccacctctttcttattttcttcctgggattggggaggggatgattcagaccccacatggcctccaaccttggcccacacacctgccatggctcccatcatcctgagcatgctagcgtcccctcctcacctgacaatggaggctctcgaattgggttgtgtccccccaaaatttatgtctacccagaacctcagaacatgagcttacttggaaatagggtctttgcaggtgtaactggttaaattaaaagaggtattactggaggaggatggatgaatccagtgactggttcctcatatgaagtagagaagagatgcagagaaacacatggggaagatgccacgtgaagacagaggcagtggttggatcaatgcatctacgagtcggagaacccaaggattgccagcaacaaccagaaatcaggaggggggcatgagatgcattatttcttagagcctttagagggaacatggccctactgacaccttgatgtcagacttctggctgctagaactgtcagagaataaatttctgttgtttgatgcc

SEQ ID NO: 29286 - DNA, 5061 bp, Homo sapiens
ccccattcgcaggacagctcttacctgccgggccgccgccccagccaacagctcagccgggtgctccttcctgggctccacgcccggagctgcttcctgacggtgcagccgcaaggcatcgcaggggccccgcgctactgccctgctccctcaaagtcccaggtcccctcccctggtgctgatcattaaccaggaggccgtataaggagctagcggccctggcgagagggaaggacgcaacgctgccaccatggacagtagcacctggagccccaagaccaccgcggtcacccggcctgttgagacccacgagctcattcgcaatgcagccgatatctccatcatcgttatctacttcgtggtagtgatggccgtcggactgtgggctatgttttccaccaatcgtgggactgttggaggcttcttcctggcaggccgaagtatggtgtggtggccgattggagcctccctctttgctagtaacattggaagtggccactttgtggggctggccgggactggggcagcttcaggcatcgccattggaggctttgaatggaatgccctggttttggtggttgtgctgggctggctgtttgtccccatctatattaaggctggggtggtgacaatgccagagtacctgaggaagcggtttggaggccagcggatccaggtctacctttcccttctgtccctgctgctctacattttcaccaagatctcggcagacatcttctcgggggccatattcatcaatctggccttaggcctgaatctgtatttagccatctttctcttattggcaatcactgccctttacacaattacagggggcctggcggcggtgatttacacggacaccttgcagacggtgatcatgctggtggggtctttaatcctgactgggtttgcttttcacgaagtgggaggctatgacgccttcatggaaaagtacatgaaagccattccaaccatagtgtctgatggcaacaccacctttcaggaaaaatgctacactccaagggccgactccttccacatcttccgagatcccctcacgggagacctcccatggcctgggttcatctttgggatgtccatccttaccttgtggtactggtgcacagatcaggtcattgtgcagcgctgcctctcagccaagaatatgtctcacgtgaagggtggctgcatcctgtgtgggtatctaaagctgatgcccatgttcatcatggtgatgccaggaatgatcagccgcattctgtacacagaaaaaattgcctgtgtcgtcccttcagaatgtgagaaatattgcggtaccaaggttggctgtaccaacatcgcctatccaaccttagtggtggagctcatgcccaatggactgcgaggcctgatgctatcagtcatgctggcctccctcatgagctccctgacctccatcttcaacagcgccagcaccctcttcaccatggacatctacgccaaggtccgcaagagagcatctgagaaagagctcatgattgccggaaggttgtttatcctggtgctgattggcatcagcatcgcctgggtgcccattgtgcagtcagcacaaagtgggcaactcttcgattacatccagtccatcaccagttacttgggaccacccattgcggctgtcttcctgcttgctattttctggaagagagtcaatgagccaggagccttttggggactgatcctaggacttctgattgggatttcacgtatgattactgagtttgcttatggaaccgggagctgcatggagcccagcaactgtcccacgattatctgtggggtgcactacttgtactttgccattatcctcttcgccatttctttcatcaccatcgtggtcatctccctcctcaccaaacccattccggatgtgcatctctaccgtctgtgttggagcctgcgcaacagcaaagaggagcgtattgacctggatgcggaagaggagaacatccaagaaggccctaaggagaccattgaaatagaaacacaagttcctgagaagaaaaaaggaatcttcaggagagcctatgacctattttgtgggctagagcagcacggtgcacccaagatgactgaggaagaggagaaagccatgaagatgaagatgacggacacctctgagaagcctttgtggaggacagtgttgaacgtcaatggcatcatcctggtgaccgtggctgtcttttgccatgcatattttgcctgagtcctaccttttgctgtagatttaccatggctggactcttactcaccttcctttagtctcgtcctgtggtgttgaagggaaatcagccagttgtaaattttgcccaggtggataaatgtgtacatgtgtaattataggctagctggaagaaaaccattagtttgctgttaatttatgcatttgaagccagtgtgatacagccatctgtacctactggagctgcagaagggaagtccactcagtcacatccagaaaaaggcagactaagaatcagaagccatgtgattgatgtctgacgtgagtctgtctcaggtagattccgggtgtcagtgtggtttataatccttgaatattgttttagaaactttggtctccctggttcctgccacttttcctgtccgtcctcctccccattttttttttaaaagaaagctgttttcccctcatcatatccctcttgagttttgcctggactttccctctcaagtgtgtcaatcaggtaaactgaggaatgcatggaagctgaggatggagcttgatgggctccctgtcctgggtgtttgctctctgaagtggaggcctgaggaaggtagtacttccacaaaagggagggacccgggccccagcctcaagctagtgggggaggcagatagcctgaatccaggggattttctgggcttcttaaaatgtccattgtgagttccccgtgtttgggattccactcattttggcattcacagtgcctggaatgtcttagattttcagcaatgcgtgttgaataaatgaatgacataggcatttatttttaaatctttgcttgctttttacatgagcctggcccttagttaaccttttcttgtggctacacaaagtatgctcactggttactaatgacttgggatgcatttgtcaaactgattatattagttttctagggatgccataacaaagtagcacagaccagatggctcaagcagcagacatttattttctcacagttctagaggctagaagttggaggccaagatgtcagcagggttggtttcttctgaggcctctctccttggttgcagatggtcatatctcactctgtcttccgtggccttccttttgtctgtgtcctaaatctactcttctgataaggacatcagtcatattggaataggacccaccctaatgtcttcattttaatcacctctttaaagcccctacctccaaatacagtcacactgtgagaaactgagggttaggaagtcagcaagtgagtcttgaagagatactaaacaaacccacaacacagataaagtatgcattttggagatttccaagccagagtctcccgtgaaaaaggtaaacggaagcagttattgtgcagcaaaaggaaaaagaattacaaactgaacgtatgtaggtgaggcaaggcagggtagggcagggcctttgggtaggctgatcagagggtttttcaacaataaatcaatgggaatgcatttgttgctcccaggaccctggcaccttgactctggtactatagcatgtcagcaaatacaagcaaagcccaacactctgatttgcatttatgccaatctaaactatccggtgtttagtttgattttttgagtgcaggttcattcaaggaccaggttcccttgtgctcagggtgaagtagaaccagaaaacatcgttatccattcccagaagttttggaagagccttggtagaaaagcagaagctgctttgaccgtgaaaatatttgactcctatcagtttttggtcaggagaagatatccacctagaccaacctgaggagaaggctcagagtacagatataccccgagcaacgtgatcaatgtccttgaaccttcatttttcatctgaaaacagagacataaatgcctggctcacagatttaaatgttatacattgacagcatttatcagtataacatttatttaaataagtaggtgctcaataggtgttggtcttctaacttgtctacatcccatccccattccagggtcttcagaattgaaggagagatgttgtatcactgttagaaggctgctttgggacattctgcagcagggaggagggactgtcaacccctacaccatgaccaccaagttcctcaccttggctgagtccctaaaactctctgaacctcaggttcctccaagcataatgcagacttcacagagctgttgtaaagattaggtgaggtcaattgatactgcttaaaaggcccggtccgtagaaaatgcccaataaacattactgctttccccctcaccctactgcctgaaaaaatattacacctgtgagactgactttgagaaccagtgtgggtggggagttgtgcatataaactatttaatgagtaccaaacacaaaagtcaagcttgtaaaatatcaggccttgccccagaaagacaaataccacatgatctcactgatatgtagaatcttaaaaagtcaaactcagaagcagagagtagaatgatggttatcaagggctgggggagggagggactggggagatgttggtcaaatgatacaaaggtttagttaggtggaataagttcagaaaatcaattgtacaatgtatcaattatagttaatagcaatataacatatacttgaaaattgctgagagtagtgtgagtgttctaccacaaaaaaatatgtgcagtaatagatgttaattaccttaatttagtcatttcacaatatgtacatatataaaaatatgttgtatgccatgagtatatataattattatttgtgaatttaaaaaataaaaataatttccaaaaaaa

SEQ ID NO: 29287 - DNA, 2088 bp, Homo sapiens
actgcactcctgcctgggcgacagaaaaagactctgtcccaaaagtgggctctttgaaggctagaaggtatttggggcagcagacttgtgtggaagcagttatcaaagtggggatgtgacacgcaccaggagaggggaacagacaacacatgagattggagcctccctctttgctagtaacattggaagtggccactttgtggggctggccgggactggggcagcttcaggcatcgccattggaggctttgaatggaatgccctggttttggtggttgtgctgggctggctgtttgtccccatctatattaaggctggggtggtgacaatgccagagtacctgaggaagcggtttggaggccagcggatccaggtctacctttcccttctgtccctgctgctctacattttcaccaagatctcggcagacatcttctcgggggccatattcatcaatctggccttaggcctgaatctgtatttagccatctttctcttattggcaatcactgccctttacacaattacagggggcctggcggcggtgatttacacggacaccttgcagacggtgatcatgctggtggggtctttaatcctgactgggtttgcttttcacgaagtgggaggctatgacgccttcatggaaaagtacatgaaagccattccaaccatagtgtctgatggcaacaccacctttcaggaaaaatgctacactccaagggccgactccttccacatcttccgagatcccctcacgggagacctcccatggcctgggttcatctttgggatgtccatccttaccttgtggtactggtgcacagatcaggtcattgtgcagcgctgcctctcagccaagaatatgtctcacgtgaagggtggctgcatcctgtgtgggtatctaaagctgatgcccatgttcatcatggtgatgccaggaatgatcagccgcattctgtacacagaaaaaattgcctgtgtcgtcccttcagaatgtgagaaatattgcggtaccaaggttggctgtaccaacatcgcctatccaaccttagtggtggagctcatgcccaatggactgcgaggcctgatgctatcagtcatgctggcctccctcatgagctccctgacctccatcttcaacagcgccagcaccctcttcaccatggacatctacgccaaggtccgcaagagagcatctgagaaagagctcatgattgccggaaggttgtttatcctggtgctgattggcatcagcatcgcctgggtgcccattgtgcagtcagcacaaagtgggcaactcttcgattacatccagtccatcaccagttacttgggaccacccattgcggctgtcttcctgcttgctattttctggaagagagtcaatgagccaggagccttttggggactgatcctaggacttctgattgggatttcacgtatgattactgagtttgcttatggaaccgggagctgcatggagcccagcaactgtcccacgattatctgtggggtgcactacttgtactttgccattatcctcttcgccatttctttcatcaccatcgtggtcatctccctcctcaccaaacccattccggatgtgcatctctaccgtctgtgttggagcctgcgcaacagcaaagaggagcgtattgacctggatgcggaagaggagaacatccaagaaggccctaaggagaccattgaaatagaaacacaagttcctgagaagaaaaaaggaatcttcaggagagcctatgacctattttgtgggctagagcagcacggtgcacccaagatgactgaggaagaggagaaagccatgaagatgaagatgacggacacctctgagaagcctttgtggaggacagtgttgaacgtcaatggcatcatcctggtgaccgtggctgtcttttgccatgcatattttgcctgagtcctaccttttgctgtagatttaccatggctggactcttactcaccttcctttagtctcgtcctgtggtgttgaagggaaatcagccagttgtaaattttgcccaggtggataaatgtgtacatgtgtaattataggctagctgg

SEQ ID NO: 29288 - DNA, 2269 bp, Homo sapiens
ctttaggagaggagcagacagctcttagctagggtcagatttcaaattctcatctcttggtgccaataccaccaccagattcttctttgaagtcaacttttgagatcttcactaagtacacgttggtgtctgaagattcacacgagtgcctctggtaatcattttcttcagggaatcacagtctctcctctcagcaaagcatccactgtactgaactttgcttttggaaacatcttcttcctgagacctcgttgaaagaaactctctggtgtcatactttccaatatggaggtgaagaactttgcagtttgggattatgttgtatttgcagccctctttttcatttcctctggaattggggtgttctttgccattaaggagagaaaaaaggcaacttcccgagagttcctggttgggggaaggcaaatgagctttggccctgtcggcttgtctctgacagccagcttcatgtcagctgtcacggtcctggggaccccttctgaagtctaccgctttggggcatccttcctagtcttcttcattgcttacctatttgtcatcctcttaacatcagagctctttctccctgtgttctacagatctggtatcaccagcacttatgagtacttacaactacgattcaacaaaccagttcgctatgctgccacggtcatctacattgtacagacgattctctacacaggagtggtggtgtatgctcctgccctggcactcaatcaagtgactgggtttgatctctggggctctgtgtttgcaacaggaattgtttgcacattctactgtaccctgggaggattaaaagcagtggtgtggacagatgcatttcagatggttgtcatgattgtgggcttcttaacggttctcattcaaggatcaactcatgctgggggattccacaatgtattagagcaatcaacaaatggatctcgactacatatatttgactttgatgtagatcctctcaggcgacacactttttggactatcacagtgggaggaacttttacttggctcggaatctatggggtcaatcaatcaactattcagcgatgcatctcttgcaaaacagaaaagcatgctaagcttgccttgtattttaacttgctgggtctctggatcattctggtgtgtgctgtcttctctggcttaatcatgtactctcactttaaagactgtgacccttggacttctggcatcatctcagcaccagaccagctgatgccgtactttgtcatggagatatttgccacaatgccaggactgccaggactttttgtggcttgtgccttcagtggaactctgagcaccgtggcttccagcatcaatgccttggcaacagtgacctttgaggattttgtcaagagctgttttcctcatctctccgacaagctgagcacctggatcagtaaaggcttatgtaggtacagctggtggactttctattccatatcatgaaatgtacatgtggtagatgtcaaaatcctgcatgtgctattcaggacacacttataaacacaaatgcactgtgagatatgtgaagaatcccacacatagattcttacacttccaaagatccagcagggtatcaggaaagaatgactagctagtttaccttaactgcctttattttcagatactcttctatacttaccctacactctagacgaggcttatccaacccacggcctgtgggccgcatacggcccaggatggctttgaatgcagcccaacacaaattcgtaaactttcttaaaacattctggaatttttttgtaattttttaaatcttagcagctatcattagtgtttgtgtattttatgtgtactccaaggcaactccttctttcaacgtggcccagggaggccaaaagattggacacccctgcaaactaatcacatcaatctctcttgattacactgtgtgatggtcatattagtctctctacatgggaagatgttgtgcttactatggccagtcactttgacaaagaaaagccaaattcttttctaaagaattgttccttattaccaaactcccagtaaccccctcaaagaataattgccccttgcttaatcatgcaattgcatattatgtttatactcacttcagcacttatcagagataattgcagtttcacaaggtttactttttaaagtataaacaaattatgtatttacttactaatagaaaatataggtaatttggggaaatttatgtacattgttaaataaaattatatctatctaa

SEQ ID NO: 29289 - DNA, 6250 bp, Homo sapiens
ctgaattccttctctgtggcatatgctttaggagaggagcagacagctcttagctagggtcagatttcaaattctcatctcttggtgccaataccaccaccagattcttctttgaagtcaacttttgagatcttcactaagtacacgttggtgtctgaagattcacacgagtgcctctggtaatcattttcttcagggaatcacagtctctcctctcagcaaagcatccactgtactgaactttgcttttggaaacatcttcttcctgagacctcgttgaaagaaactctctggtgtcatactttccaatatggaggtgaagaactttgcagtttgggattatgttgtatttgcagccctctttttcatttcctctggaattggggtgttctttgccattaaggagagaaaaaaggcaacttcccgagagttcctggttgggggaaggcaaatgagctttggccctgtcggcttgtctctgacagccagcttcatgtcagctgtcacggtcctggggaccccttctgaagtctaccgctttggggcatccttcctagtcttcttcattgcttacctatttgtcatcctcttaacatcagagctctttctccctgtgttctacagatctggtatcaccagcacttatgagtacttacaactacgattcaacaaaccagttcgctatgctgccacggtcatctacattgtacagacgattctctacacaggagtggtggtgtatgctcctgccctggcactcaatcaagtgactgggtttgatctctggggctctgtgtttgcaacaggaattgtttgcacattctactgtaccctgggaggattaaaagcagtggtgtggacagatgcatttcagatggttgtcatgattgtgggcttcttaacggttctcattcaaggatcaactcatgctgggggattccacaatgtattagagcaatcaacaaatggatctcgactacatatatttgactttgatgtagatcctctcaggcgacacactttttggactatcacagtgggaggaacttttacttggctcggaatctatggggtcaatcaatcaactattcagcgatgcatctcttgcaaaacagaaaagcatgctaagcttgccttgtattttaacttgctgggtctctggatcattctggtgtgtgctgtcttctctggcttaatcatgtactctcactttaaagactgtgacccttggacttctggcatcatctcagcaccagaccagctgatgccgtactttgtcatggagatatttgccacaatgccaggactgccaggactttttgtggcttgtgccttcagtggaactctgagcaccgtggcttccagcatcaatgccttggcaacagtgacctttgaggattttgtcaagagctgttttcctcatctctccgacaagctgagcacctggatcagtaaaggcttatgtctcttatttggcgtgatgtgtacctctatggctgtggctgcatctgtcatgggaggtgttgtgcaggcttccctcagcattcacggcatgtgtggaggaccaatgctgggcttattctccctgggaatcgtgttcccttttgtgaattggaagggtgcactaggaggtcttcttactggaatcaccttgtcattttgggtggccattggggccttcatttaccctgcaccagcctctaagacatggcctttgcctctgtcaacagaccaatgtatcaaatcaaatgtgacagcaacagggcctccagtactatccagcagacctggaatagctgatacctggtactcgatctcctacctttactacagtgcagtgggctgcttaggatgcattgttgctggagtaatcatcagcctcataacaggtcgccaaagaggtgaggatattcaaccactgttaattagaccagtttgtaatttattttgcttttggtctaagaagtacaaaacactatgctggtgtggagttcagcatgacagtgggacagagcaggaaaaccttgagaatggcagtgcccggaaacagggggctgaatctgtcttacagaacggactcagaagagaaagcctggtacatgttccaggctatgatcctaaggacaaaagctacaacaatatggcatttgagactacccatttctaaggcaatacctgtatgaatgcacacacacacgtgcaatacacacacacacacacaaactccacatacttcttgcctacttgttagtagatatgtatagttgccattgctagaagacagggatgtctggtgcctatttctacttatttataactacatgcaaaatgactgtctctcgggatattctttgaaagactccaactttcacagagaaaaaccaacctgctccaaatgcccttgactacttccttcttgaataaattagggctggatttcattaccattcaagaaagcgaagtctttttgcttggtgtcatattaaacttcaggtttttcgttttagtagttttttaaccatcaaaatatcttggagtttagaggcagaacgggaaacagaaatatgcatatttaacactttcctgccacgagggataaaatagaggaatgacatccacccctgacctcatacctgacatacatgtagatatattttatgccacccatctcccatcctgtagctacaattggcatacaactactattaacctcccttcaccaccactgtcaggtcctcttccagtcattccagtcattagctgtcctgaccaaacattaaaaaaaaaattcagctaaatacagaagaagatggtatgtctggctagtgggagtgattataactaaaaactttgctccttttgtgctgtccatgcagtatgtcttcttcctttctatcactttacaatgaaaaattgcctcagagctcaataagaagtctagagcctttttccagggctaaggaaagagaaaaggaatgtcctatagaaggttgttaggatagaatttggtaaaagaacgttgcaaatattgtaacagaccataggagatttcatcagcaataggattcttctttggagaaaatacattgtccataagacttgtactctgctcattcaactcatgtgagcaagctcaactcactccacctgggttaggtaacagaagtggagaacttcatagttcgtgtctagaaaataatgtttaaagttctggagaatgagggtattgcagattaaaaggcgagttgacaaatgaaggagcagtgaaagatttttggaagaagtgaagaagtgaaattctgaaaaggtaaaagaaagaaccagtatgtcacaggggccaagtcagaggacagataataagaaacaaagttgtatctgagagtcatatattaggacaggtgtcagatatttattttggtggccagataaaagcaaaaggcctagaaacagtgtgttagcaaagtaagaagaaatggtccaaataggcaaggataaggaaatccaaaggttgtctttaaatatttctcaaaagagaaagccttgaaagaagcatacaatagagaaaaaataaattaccagtatttattattagaaaagatagaaagacagacaaatcagtggaggaattaaaacagagaaactggagtttataaaacagagcccaatccttgccttctctccctccactcaaatagaaaaggagaatggagaaagagaaagaaggtattaggctacagtttataagagagatgagaaaaaaatacatttgggaatagagggaaagggtcaaaaggggtcacatttggagaaatatctgaaaatgagaaggagcagaatttttggaaacattttttaaagtctggcaacgctaattaagctgttgatctaaggatttgcaaattgagaggtgcaattattttccaaatgatttgtgacactcttattaattagaatatatattttgtgaatattgaaatctgagccaaaactagttagctttattaatatcttagggaaagaagagagaaagaaagagggagggagagagagaaagaaagaaagaaagaaagaaagaaagaaaagaagaaagaaagaaagaaaaagacaggaagaggaagagagagacagaaagaataaaaaaacagcaattctgaggatgagaataaattaatggtaggtattacatatgcatatacatatatatatctgtacacatatatatgtaaatatgatttggaatacatcaggattgtgaacttccacttgggatagcataaaagcaaaatataccatacaatttttcattttactcacaaattttactcacaaattctcctaaagacatttcactaggtcagtacatttccgagaaagttttaaaaacgtttcttcttttatagtccctaattatcttacctggagtgttatcaaaatgtcatacaactggaaaatgcaattattattataaaaatatctctgccttctcttgtgtaatgaaatttatggcattaggagatgacatttcaagagattttagaggtcaatgtagagactccccccattcttcttaattgaacaaacatgcataaatctagggtttcaggtagagagcagatgggaatctacaggaaactgtcttccatagtgtatgaaaaccgtgtttgttgtgtggtgaagcaaaaggaaactatgaagcgcacagtcaatagattcagctagtgagtcccagcactcctttcaggccctcactaggattagcagcccagagtcatgccaaggccactggtgcagtacaaagacagttcagtgacaagttccatccataccatggaagagggttaaacttgtggctgtttttgccacagcatgaccagagacattctcaataaatggcactaggaatgatgagttttagaggggcctaaaatgttccaaacttgatactcaccactgtacctttaaagcacaaccacagatattggtaaaaatggaacagaattacctcaatacctctttaactcattctgtatgaattcattttgatgacagacattttttgtcaccatttggaataagaactacaacagcttatgattgaggtgaggaactgcagtcaaatggcttaggttcaaacacgagttctgacacaaatctaggtaattttgggcaatattttaaaatcttagtttattcaccaattaataggagtaaaaattacccctacttaatagaattattatgaagatttatataagtaaatcatataaagtgcttagcacagtgtgactggcccacatggaacatttaatacttggtctgcagtatatgaagaaaatggtgtacatgttaacttaaatggtttcattatttctcttcaggatttttaagatgtgggatcagaatatatgttactattttgagaattagaaataataagaaaaacagaatgtatacattaaaagtcatgcctaaatttccaaagagtagtttttttaatgccagagtttaaataaaatattattttccagagagtaacttttctaaaggtcctaaattctgaaaagagagaaaactactgttataaacaagtttattactaaaagatgcaattcattactatgatttattattattttgtacatgtaaaccttgataaataaacagcatctcaacccaagtttattactcattgcacagttcaaagcaactatgactctcaaaatagcaacagaaggtggggagggtcttttccctttgtttatatagtatttgctaaaaatgaactttactattttgtggctttatagggttacaccatttcattctaaagagaaacaaaaagtaaaccattggccatgtggctttcaaacagtatttcaaagagaatattactgaaatatttttgtgctgttacagtcttaatcaaacattattacaaagatcagatacggaaaaaatagaggagtctccccttaattgttccctttgaaataaattgttttaaattattacagaagttatagctgtatgtacatgcacatttgtatatttacaagtctcatgtacttaatctcaatattgcaaattagctaggtttactatagagttaactgcttttatctagcatttataatcttgtagtataacctattttcaaataactaaaatttaattgatgtcatcaatggtacacatgaaaatgatacaaatttataaactaataaaatgtaactcgtcattgatagtaaat

SEQ ID NO: 29290 - DNA, 1932 bp, Homo sapiens
ggtaaatatattaaagaccaagatttgcagtaacatttatcatatcaaatctccaaatctagtggaggaatttaaacagaggacacagacagctcttgggagagtcttcatatttttattgtacttacaactacgattcaacaaaccagttcgctatgctgccacggtcatctacattgtacagacgattctctacacaggagtggtggtgtatgctcctgccctggcactcaatcaagtgactgggtttgatctctggggctctgtgtttgcaacaggaattgtttgcacattctactgtaccctgggaggattaaaagcagtggtgtggacagatgcatttcagatggttgtcatgattgtgggcttcttaacggttctcattcaaggatcaactcatgctgggggattccacaatgtattagagcaatcaacaaatggatctcgactacatatatttgactttgatgtagatcctctcaggcgacacactttttggactatcacagtgggaggaacttttacttggctcggaatctatggggtcaatcaatcaactattcagcgatgcatctcttgcaaaacagaaaagcatgctaagcttgccttgtattttaacttgctgggtctctggatcattctggtgtgtgctgtcttctctggcttaatcatgtactctcactttaaagactgtgacccttggacttctggcatcatctcagcaccagaccagctgatgccgtactttgtcatggagatatttgccacaatgccaggactgccaggactttttgtggcttgtgccttcagtggaactctgagcaccgtggcttccagcatcaatgccttggcaacagtgacctttgaggattttgtcaagagctgttttcctcatctctccgacaagctgagcacctggatcagtaaaggcttatgtaggtctcttatttggcgtgatgtgtacctctatggctgtggctgcatctgtcatgggaggtgttgtgcaggcttccctcagcattcacggcatgtgtggaggaccaatgctgggcttattctccctgggaatcgtgttcccttttgtgaattggaagggtgcactaggaggtcttcttactggaatcaccttgtcattttgggtggccattggggccttcatttaccctgcaccagcctctaagacatggcctttgcctctgtcaacagaccaatgtatcaaatcaaatgtgacagcaacagggcctccagtactatccagcagacctggaatagctgatacctggtactcgatctcctacctttactacagtgcagtgggctgcttaggatgcattgttgctggagtaatcatcagcctcataacaggtcgccaaagaggtgaggatattcaaccactgttaattagaccagtttgtaatttattttgcttttggtctaagaagtacaaaacactatgctggtgtggagttcagcatgacagtgggacagagcaggaaaaccttgagaatggcagtgcccggaaacagggggctgaatctgtcttacagaacggactcagaagagaaagcctggtacatgttccaggctatgatcctaaggacaaaagctacaacaatatggcatttgagactacccatttctaaggcaatacctgtatgaatgcacacacacacgtgcaatacacacacacacacacaaactccacatacttcttgcctacttgttagtagatatgtatagttgccattgctagaagacagggatgtctggtgcctatttctacttatttataactacatgcaaaatgactgtctctcgggatattctttgaaagactccaactttcacagagaaaaaccaacctgctccaaatgcccttgactacttccttcttgaataaattagggctggatttcattaccattcaagaaa

SEQ ID NO: 29291 - DNA, 2271 bp, Homo sapiens
ggggcagatcctggggagaatggaggagcacacagaggcaggctcggcaccagagatgggggcccagaaggccctgattgacaatcctgctgacatcctagtcattgctgcatatttcctgctggtcattggcgttggcttgtggtccatgtgcagaaccaacagaggcactgtgggcggctacttcctggcaggacgcagcatggtgtggtggccggttggggcctctctcttcgccagcaacatcggcagtggccactttgtgggcctggcagggactggcgctgcaagtggcttggctgttgctggattcgagtggaatgcgctcttcgtggtgctgctactgggctggctgtttgcacccgtgtacctgacagcgggggtcatcacgatgccacagtacctgcgcaagcgcttcggcggccgccgcatccgcctctacctgtctgtgctctcccttttcctgtacatcttcaccaagatctcagtggacatgttctccggagctgtattcatccagcaggctctgggctggaacatctatgcctccgtcatcgcgcttctgggcatcaccatgatttacacggtgacaggagggctggccgcgctgatgtacacggacacggtacagaccttcgtcattctggggggcgcctgcatcctcatgggttacgccttccacgaggtgggcgggtattcgggtctcttcgacaaatacctgggagcagcgacttcgctgacggtgtccgaggatccagccgtgggaaacatctccagcttctgctatcgaccccggcccgactcctaccacctgctccggcaccccgtgaccggggatctgccgtggcccgcgctgctcctcggactcacaatcgtctcgggctggtactggtgcagcgaccaggtcatcgtgcagcgctgcctggccgggaagagcctgacccacatcaaggcgggctgcatcctgtgtgggtacctgaagctgacgcccatgtttctcatggtcatgccaggcatgatcagccgcattctgtacccagacgaggtggcgtgcgtggtgcctgaggtgtgcaggcgcgtgtgcggcacggaggtgggctgctccaacatcgcctacccgcggctcgtcgtgaagctcatgcccaacggtctgcgcggactcatgctggcggtcatgctggccgcgctcatgtcctcgctggcctccatcttcaacagcagcagcacgctcttcaccatggacatctacacgcgcctgcggccacgcgccggcgaccgcgagctgctgctggtgggacggctctgggtggtgttcatcgtggtagtgtcggtggcctggcttcccgtggtgcaggcggcacagggcgggcagctcttcgattacatccaggcagtctctagctacctggcaccgcccgtgtccgccgtcttcgtgctggcgctcttcgtgccgcgcgttaatgagcagggcgccttctggggactcatcgggggcctgctgatgggcctggcacgcctgattcccgagttctccttcggctcgggcagctgtgtgcagccctcggcgtgcccagctttcctctgcggcgtgcactacctctacttcgccattgtgctgttcttctgctctggcctcctcaccctcacggtctccctgtgcaccgcgcccatccccagaaagcacctccaccgcctggtcttcagtctccggcatagcaaggaggaacgggaggacctggatgctgatgagcagcaaggctcctcactccctgtacagaatgggtgcccagagagtgccatggagatgaatgagccccaggccccggcaccaagcctcttccgccagtgcctgctctggttttgtggaatgagcagaggtggggtgggcagtcctccgccccttacccaggaggaggcagcggcagcagccaggcggctggaggacatcagcgaggacccgagctgggcccgtgtggtcaacctcaatgccctgctcatgatggcagtggccgtgttcctctggggcttctatgcctaagaccaactgcgttggacaccataagccacagcctcacaggaagtgggggtgaggagcctgcggtgctccccagaaaaggggaaggggcagtggggtgagaaggtcctggctccccttctcccggccttcctctgcctggggcccactgcatctgattggcagtcacttcccatgagggcctggcccacccgctgcagttgccctaaggaaaaataaagctgcctttcccctgt

SEQ ID NO: 29292 - DNA, 1852 bp, Homo sapiens
ggggcagatcctggggagaatggaggagcacacagaggcaggctcggcaccagagatgggggcccagaaggccctgattgacaatcctgctgacatcctagtcattgctgcatatttcctgctggtcattggcgttggcttgtggtccatgtgcagaaccaacagaggcactgtgggcggctacttcctggcaggacgcagcatggtgtggtggccggttggggcctctctcttcgccagcaacatcggcagtggccactttgtgggcctggcagggactggcgctgcaagtggcttggctgttgctggattcgagtggaatgcgctcttcgtggtgctgctactgggctggctgtttgcacccgtgtacctgacagcgggggtcatcacgatgccacagtacctgcgcaagcgcttcggcggccgccgcatccgcctctacctgtctgtgctctcccttttcctgtacatcttcaccaagatctcagtggacatgttctccggagctgtattcatccagcaggctctgggctggaacatctatgcctccgtcatcgcgcttctgggcatcaccatgatttacacggtgacaggagggctggccgcgctgatgtacacggacacggtacagaccttcgtcattctggggggcgcctgcatcctcatgggttacgccttccacgaggtgggcgggtattcgggtctcttcgacaaatacctgggagcagcgacttcgctgacggtgtccgaggatccagccgtgggaaacatctccagcttctgctatcgaccccggcccgactcctaccacctgctccggcaccccgtgaccggggatctgccgtggcccgcgctgctcctcggactcacaatcgtctcgggctggtactggtgcagcgaccaggtcatcgtgcagcgctgcctggccgggaagagcctgacccacatcaaggcgggctgcatcctgtgtgggtacctgaagctgacgcccatgtttctcatggtcatgccaggcatgatcagccgcattctgtacccagacgaggtggcgtgcgtggtgcctgaggtgtgcaggcgcgtgtgcggcacggaggtgggctgctccaacatcgcctacccgcggctcgtcgtgaagctcatgcccaacgggcgccttctggggactcatcgggggcctgctgatgggcctggcacgcctgattcccgagttctccttcggctcgggcagctgtgtgcagccctcggcgtgcccagctttcctctgcggcgtgcactacctctacttcgccattgtgctgttcttctgctctggcctcctcaccctcacggtctccctgtgcaccgcgcccatccccagaaagcacctccaccgcctggtcttcagtctccggcatagcaaggaggaacgggaggacctggatgctgatgagcagcaaggctcctcactccctgtacagaatgggtgcccagagagtgccatggagatgaatgagccccaggccccggcaccaagcctcttccgccagtgcctgctctggttttgtggaatgagcagaggtggggtgggcagtcctccgccccttacccaggaggaggcagcggcagcagccaggcggctggaggacatcagcgaggacccgagctgggcccgtgtggtcaacctcaatgccctgctcatgatggcagtggccgtgttcctctggggcttctatgcctaagaccaactgcgttggacaccataagccacagcctcacaggaagtgggggtgaggagcctgcggtgctccccagaaaaggggaaggggcagtggggtgagaaggtcctggctccccttctcccggccttcctctg

SEQ ID NO: 29293 - DNA, 11574 bp, Homo sapiens
cggaccgtgctttcgccgcctgggagccgtccggcgcagcagtttctaggtccccactgtccccgccgtcccgccccttcgcgtcccgggaaccggctggcttccgagccgcactcgccgatcctccaggcatgccccgctacgagctggctttaatcctgaaagccatgcagcggggttggtacagtaggcttcactagacttagctgcaactcagaatttctcctccagcacctgagtaaatgctgatggtcttgtggagagtggattaagagtacgagctaagttctcaatcccaattaagaagcggaaaatttaaactgtcttcttcaaagtttatcacaaccaccaccatcaagacagcaaaccaaaggacaaagactttgaccctgctgtgttgctctgtgtagtccagttcacgtatggtttacagacttggctggggttactaaaaataaataaaaagttggacacttctgtcattggagcgctattattcacaagttaccagaatgagagctgtactggacacagcagacattgccatagtggccctgtattttatcctggtcatgtgcattggtttttttgccatgtggaaatctaatagaagcaccgtgagtggatacttcctggcggggcgctctatgacctgggtaacaattggtgcctctctgtttgtgagcaatattgggagtgagcacttcattgggctggcaggatctggagctgcaagtggatttgcagtgggcgcatgggaattcaatgccttactgcttttacaacttctgggatgggttttcatcccaatttacatccggtcaggggtatataccatgcctgaatacttgtccaagcgatttggtggccataggattcaggtctattttgcagccttgtctctgattctctatattttcaccaagctctcggtggatctgtattcgggtgccctttttatccaggagtctttgggttggaatctttatgtgtctgtcatcctgctcattggcatgactgctttgctgactgtcaccggaggccttgttgcagtgatctacacagacactctgcaggctctgctcatgatcattggggcacttacacttatgattattagcataatggagattggcgggtttgaggaagttaagagaaggtacatgttggcctcacccgatgtcacttccatcttattgacatacaacctttccaacacaaattcttgtaatgtctcccctaagaaagaagccctgaaaatgctgcggaatccaacagatgaagatgttccttggcctggattcattcttgggcagaccccagcttcagtatggtactggtgtgctgaccaagtcatcgtgcagagggtccttgcagccaaaaacattgctcatgccaaaggctctactcttatggctggcttcttaaagctcctgccaatgtttatcatagttgtcccaggaatgatttccaggatactgtttactgatgatatagcttgcatcaacccagagcactgcatgctggtgtgtggaagcagagctggttgctccaatattgcttacccacgcctggtgatgaagctggttcctgtgggccttcggggtttaatgatggcagtgatgattgcagctctgatgagtgacttagactctatctttaacagtgccagtaccatattcaccctcgatgtgtacaaacttatccgcaagagcgcaagctcccgggagttaatgattgtggggaggatatttgtggcatttatggtggtgatcagcatagcatgggtgccaatcatcgtggagatgcaaggaggccagatgtacctttacattcaggaggtagcagattacctgacacccccagtggcagccttgttcctgctggcaattttctggaagcgctgcaatgaacaaggggctttctatggtggaatggctggctttgttcttggagcagtccgtttgatactggcctttgcctaccgtgccccagaatgtgaccaacctgataataggccgggcttcatcaaagacatccattatatgtatgtggccacaggattgttttgggtcacgggactcattactgtaattgtgagccttctcacaccacctcccacaaaggaacagattcgaaccaccaccttttggtctaagaagaacctggtggtgaaggagaactgctccccaaaagaggaaccataccaaatgcaagaaaagagcattctgagatgcagtgagaataatgagaccatcaaccacatcattcccaacgggaaatctgaagacagcattaagggccttcagcctgaagatgttaatctgttggtaacctgcagagaggagggcaacccagtggcatccttaggtcattcagaggcagaaacaccagttgacgcttactccaatgggcaagcagctctcatgggtgagaaagagagaaagaaagaaacggatgatggaggtcggtactggaagttcatagactggttttgtggctttaaaagtaagagcctcagcaagaggagtctcagagacctgatggaagaggaggctgtttgtttacagatgctagaagagactcggcaagttaaagtaatactaaatattggactttttgctgtgtgttcacttggaattttcatgtttgtttatttctccttatgaacttaaggatatggtgagacactaacttaagacaatactgactggtctttggggaaaaaagttatgtaactgtgcatctctcaggcattgtttacgctgtaggttttagccaaattttacttagcagaaaatcatctaattacaagactttattttcccagagatggattaaagtaaatcttcaacttaagtgaagccaaacctaacagactgaattgtgcaaatgtggttttaaattttgcataccaaagtaagaagagaccaattattctcacagagcacttagagcagaatatatgttaagttaccatgaattaaggtatactgtctgcactgccaagtcttggcagaccttaccctgaagtagaagatttgctcatttctaaagttttttttctgtctctgtaatccctcctaccattaagaaaaacttatttcttagacattgtacaatcagttatgtactgaaaatcgaatgtgcttgtgtgatacttgtttcaggacaagttcatttgccaggttcattttgttagcatgagcctacggattctgatttcccaaagaaagaatgttttcctgtaggtatttttgtaccaccagtatatggaatgttagggaaaaactttgttccagttcctttttttttttctttctactttcaagtttaagtgaaccatactgaaatgaccaacaagtctgcctgtaaagttacatgtcatgattgtgttgttaaatgattatgggggagaaaatgaagtaaatgttgctgatgatccccatatttattgatcatattaaggttgtttatatagtttggaaatgaccagccccctaagcagtgtttgattaacttatgctaatcagatgattactcatatattctgctaattttctagctttattcttgttatttggaaaaattattagccaaatgccttcctaggtggatccagttggaagatatgtccagaaacctgaagaaaaattgacgctgcctttgtgtgctggattgctctacttgattagatcatgatatatcaaggttgaatttttagagggaaaatttaattctgatatcttattgcatccttgataagtttttccctgattttttttttcctcaaaagactttccatctgtacacagcctctacatttttgttgtagtgacttagagcataaggatgtttcagtgcaaactggccgtcggtaacagaaaactcagtgcatactttgctgttgttaggttgtcaatatagtctttctgtaggatggatagcatgtttgagaggtgccaaacaagaacttttggggttagtagtgtgtcttgtggagggtattacaggactgtgtaattataggactctaacttgacatggcttggcacccacttgcagctagtgggtacagggtacaaaagatgttagagaaaagctctacagattacgtacttctgtgtcttcgtatgctcaacactgtcctttgtcctccatgaaagatgaaggaagcaaattatgtatgtactttctttgaccttctttaatctctgatactttttagattgcatgattttactaggcttgtatttagggaaattactttcataaatacttttgtagattttgaatcaaaactcagtctttttaatttttttgtagtctataaactagtttcattatgatggacttgattagtccaaagttaattttagaaattgtcaggtagcatagtgtcttcccatgatcaggaggctttctgaaggactgagtctgtaaatgaaaaaataatttatgtatgaatagcatgtatttctgaagagcttagagtgccttgtagaatttttttctcaattttattcttgaggtttataatttgggggccaaatagatagagctcatcattttcttgtttggaagttgaggctgcgacatgtccaaggttatgaagtctcttttgggaagaacagaaaccaggtctccaaatctggactcatggtttgttcagatgtgtctggacaaatggttgtcaatgttttgtcctgttttttcaaaggaactgttcttcctttgggacaaccttttggtgtttgggaaagtaataagatcttggatttttcaaattaacattaagttgtaagaactaaaattttctttgaaccacattactgtgtaattcactgataattgacatattggctgggcagcctatctcttccatatccagcgtaaatgaataggaggtgtttgtgattttttttttctccctttatttaacattgagtcctagtagtttggagaattagggtccctctaccttctttctgctcttgtcttagtaagatacataaggtacatcatcttgtgtctgtgtgtatatagcagtaggtcaagtttagagtactaaagtctgtaaataaggaatgactattagcatattcattagaattgtttattcttgccagtataaacatcattttatttagactaaagtccctgaagcttgtctttcttattgcttcccagtaatagataatgtgctcgagtaagtttgtgaattgctgattgcaacttaattcagggaccagtcttcaatctatatttcattagaatgattgttcctggaatgatcatacatggactgtcttaagctagcaaaatgttcatactttacactgactaaatgggtcctaaatgatgacattggtctttagacattaacatgtgtatatttttatattagctcaagctaaggttcagaattgaagcttgatattgactagaatagctaaaagtcaaaatgaggtgaggacactggtcttggaaggtagagaaaaataaatgtcttaccaggtgttaatggtatccccagttcttagacttttgtcttctcaggcaattttcatctcaagatctgatgagaagggcatattacattggtatgcaggatgattattgcatattttgtgggacctctaatttccctggtcatctttcagaatattctgttctgccacccccagagagtaaacacttgagccgatttcttcttccccagctattctttcctgggggtaattatgctttgtctttagattagagaagcatcaagcaatagcaatggtgctgtgtccttcggcctaaattcaatagatctcatctcctagggcttccttttcacttggctcaaaggatccattgtattttggcacaaagagcctggccagggtcatgtagccatagctcttagggatgatacctcaagaaattagctgggacccatcactctgtgaaacttcacattttaagaactgagttgagggggttgttatgcacttctgtaacttgaggctaagcaaggggttaactcttgtgagagccaatagagtgtgtctgtattcgcagtccatggctcattttctttatagtaggcatatggatcttcccctctgactttgaatatcatttggtgtggcctgtgggttattttcattctttaccaccaaataaagcggcttattagctactcagttacttgctactcaaaggttaggtcttccctgttcctgcttggcagtgttaaagcttacagggttaacttatgatgattctcctggctcattttcatcagaggcatgatgactggaaagggatcacatgggtcgttggtggtgacacctcactgtttcctaggtttggatagagagatgtatacaagacctttcctgttaaattacgtgactacagagacttgccaggacaaaattttcctaagaaatcagaaaaatgattaagtgagataagtacctgggtgacacagatattagcccgttggtaaaagacaacaaatattagcttaaaatctgcatatgtagaatcattttcattagatttagagcttgaagcaccttggctctcagctactttaaactcctccccatataaatcagggcaccaataaataagtttcagctttttaaaccctggtttgatgttaagcattataaagtacgaagtttgttaccacagtagagataatttagtagaaaaatgctttgaggcttcagtatttgtaagattttgcattagccagatgctaggttgttgaaggcatttcagtgttgataatagcctgagcagacttctttacaaatgggatctgtttctatatgtgtatatgcccacttaccattcagagagactggtctttctctttgtcttccttcacattgctgtgtcagttctacacctagtcttttcagcacttagcaaattcaaattttgatttttttgtcagcttagttcactttaaggcatattggcatggtgtgtgaaagtgatgttttgccccagtattgaggacttttagatccaaataatgactcattaaatataattatgttttaagtatactgaatttctgttagcttaaaatgttaattctcaggaatgattttctcacactttgtgttggctaataataaaagcactgttttattctcaaaactcctttttcaaaaattagggagagagcagtagtgatcatttatgtgagcccctttgaaatgatggtgtcagagtgcagagaaacaatggagttttgatgccaaaaaggtttttttgcagtaaaagtaaaaatttggaattagttggcatatagaggaacccttttgtactggaacgtatgaggctggattgtgaaaaggtaatctttcgattgctagacttggttaacttagggctgcaaatctttttcttctgtcaaggtcacttaatatggaatgtttttgtcagactgtcctttgttggaatactttagctgttcagctactttgactcctaggagagaatttagttaaggttcaaagtaattaactggctttgccagtggtgagtcccacaccattattcacttagtagtcatataaatgtttttatttaaacttctctctcttcaatgctgagaataaggctttaaattactgattcacctttaaaggaatgttgtgagaattgatgtaatttctgtttctgtttccatctaaacttctttataaaaagagggattagtttttttgttttggggtaagcacctaatttatccagtaaccaacaaccctaaccattggcatatatagtctttcactcagaaataaacaaaaactgtttggtatatctgtatcattgctaatcttgtgcactttactttttgggcagtaccatacatagtctgaggctattgacttaaaccaataactgtactttatgtaatgactcttaaatttggttacctgggttcacagcttgcttgaagagaaaggatgctagaataaagtaagcagctgaagagcgagcaaatcaagacaaaacacagtggtctcagatttttcgtagtgtgggaacagtggttttgctctataccactgaaaagcactataacataattgttgtccatgatactgaagcttttcccctcacttctaggttgtttacattcagagctctatcaataagaggaatacatattacagtgaattcgacaaccgcacaagttggcagtaggtatccccaacctaatttatcttggtaaattcaccctgtttcctagtgctgctggataaaagagtgtttactttttattgctcttagacagagtagtctagataagttttcaatttatcaacatagcctagacttctgtaagtggaatgttcattagtaactcatctttttgttgttataattggaaacagaaacgaggcttattgctattgcagaaatcccaaactggcaaaggccagtatatatggtattccataatataaccagcttttgaaatttatgtgtttggattagtgccttctggttaccagtattgactctgctagtttgcacctttccgttcttaacagaaaatttgtatttgttattcctcttaaattttgtcgtaactagtgaaggaagtaaaaaaaaaaaaaaaacatgcattacattgacatactttatgtgcagcctttatttaggttcagtgaaaccaggtagttctgtatttgtgttgtagcctaaatgttgtttcttttatatccattaaaaacttaaagttacttatgttctgtgatcttaattttgttgtgtttccattgtaggttgataggtatatcgagaacaggtacgtgacaacagtttatattccatgatagaaagctaaagtccatagaaagcacaaaatcgtgttcacacattagtgtacccacacatagaaagcacaagactaatagtattctctgtatcccacaagtgccagtcataaaggccaccaggtatttgtctcagagttgctatgagcactacagtattgataagcccaagacaatgcggtatctaaactggtcctaatggtaagggacccaaaggaataatctcaataagtttgtaccacattgatggagggagagaatataaatgtcaagaatgccaaaattatatttgggggttactagctaaaatggggtttgagggctttttactgcaacttgaaactggagaaatagggacagatgtctaggtttttggtgggtggaacaggtgacatatttctgttttaagctgtagtgtgattggggttttttgtaaaaaatcttaaatcttttaggaaatattacctcttaacagtgcccccccaaacatgcagaaagtcatactttaacagggcaaatactacttgtctttgattttttttgtgtacgtttgtatgtgagagatgaagttacctttatttttttcctatacttgactgtgcttcattttaataaaggataatttgatctgagtgttctgagcatcagactaattctgaagcatatttgctagaggagctactttgcttttcacaatggggtggagaggattctttcacttgtcccattaaccctcttctagtctagatgagatgaaatctgttaatgtgtgtgtagaagaaaacgtatgttcttctactcagcattgcccttttccacctcctcacttcacctccgagtagcttgtttatcaagaatgaatgaatgtctttgtcttaaattttgcccatgtgttaaaagatgtaattctcagaatgggagagaaatgactacctttgttcctactcttttatataattatccttttagggaaagacttggtcaactctaatatatctagaaggaagactatatctggtgtagactaatatgagatgttttagaagagttaacctgaacactttgagggagagattattcttgccagcaaaaagctagccaggaatgagcctaccacattatttgagaatatcaaacctcaggcctggggggatgaggggaagaagattaccagaagtgcaggaaagagaagtttgaggaacacccttggcttagcaacatgtgataatgcaaagctgttataacctgttaatcctacgtactatgtgttctgtacctttacatgtttttaaatttaagatagtttgtaagaactgtacaaaaaaatgcttctggagatttctttggcagaaatgcctttcatctataatttcatggagaactgctttaattagcctaggtgaaaagtagtcctagcagtgtaaatatgtataattagagttttctaatttcactgtgagatctctaacttttgagtggcaaacagatcaagtcttttgctcatagacttttctgtggggttattaaaatgcaaaagctttattttttttaataatgccatactccattagtgtcagatgatggtatggaatttgttcccttgctttcccccactgttactgcttcagtttatagattgccagcagagttcagaaatagagcagggatttacccgttctttgcttggacatcccattttcttttgtccagacccatgttggcaatcatgtatgaactgtgttatacttctcagtgctttcttttttctttttgataagatggatatcaaaaatagttgctgtgcaaaagttagtagtcttcttcaagaagaaaaccaattctttttctaataatatcctgtgaaattgcttcattcattcatttatttttaagccaaatgtcagcagagtgctgctgcttttatctagtaattttgatatgtaagtattaatgcatttttaaaagatgtctacattgaaacatgttcttcccagtgtcctgcttatgatgctttgttcagattttttgtaagagaccagttagtacactgggggtgtatattgtgtacatgtgtcattttagttaggcattgtaggccaaatgtgattataaatgaagttgatgaacattaattttgttattagtgagttttttgaattgtaaatggatttccagtttaccttctgttgtctacagcttttttaattttaaggtttgactaattgtatccatctcattgtacagtgttttagttgcaagcagaaagtagaatttggtataaagcaggttatttctatattgaaaggagtacagttgaaattgtagatttaagattgttaaaatcatgacaattctaacttgtctattctaacctattgtgtacaatctgattttttaaaattgtaaacatgtatgatcttggtttcatgtgtttttgaaagtgttattgtttaaaaaatgaaaaaagcatatctgctaaagagctgtcagttttcattactgactctgtaaaatacactgttctttgtgtactgtgtgttattttgccagctgctgcattagccttcaaaagtatttggaaacttaagatgaactacatttcttgcaaagtacattcctttctgtggtattttgtcctgtaactgaagtatagtaattattttatggaaatgttagcaattctgtaccaactttgaataaaatgaaaaattta

SEQ ID NO: 29294 - DNA, 1137 bp, Homo sapiens
gtaggtcccggcaaccgcaggctcgcggcgggcgctgggcgcgggatccgactctagtcgtaatggaggcgggcggctttctggactcgctcatttacggagcatgcgtggtcttcacccttggcatgttctccgccggcctctcggacctcaggcacatgcgaatgacccggagtgtggacaacgtccagttcctgccctttctcaccacggaagtcaacaacctgggctggctgagttatggggctttgaagggagacgggatcctcatcgtcgtcaacacagtgggtgctgcgcttcagaccctgtatatcttggcatatctgcattactgccctcggaaggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagatttttttttttaattttggaggttggggtgcaatctttagaatatgccttaaaaggccgggcgcggtggctcacgcctgtaatcccagcactttgggaggccaaggtgggcggatcgcctgaggtcaggagttcaagaccaacctgactaacatggtgaaaccccatctctactaaaaatacaaaattagccaggcatgatggcacatgcctgtaatcccagatacttgggaggctgaggcaggagaattgcttgaacccaggaggtggaggttgcagtgagctgagatcgtgccattgtgatatgaatatgccttatatgctgatatgaatatgccttaaaataaagtgttccccacccctgc

SEQ ID NO: 29295 - DNA, 1166 bp, Homo sapiens
cggcaaccgcaggctcgcggcgggcgctgggcgcgggatccgactctagtcgtaatggaggcgggcggctttctggactcgctcatttacggagcatgcgtggtcttcacccttggcatgttctccgccggcctctcggacctcaggcacatgcgaatgacccggagtgtggacaacgtccagttcctgccctttctcaccacggaagtcaacgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagatttttttttttaattttggaggttggggtgcaatctttagaatatgccttaaaaggccgggcgcggtggctcacgcctgtaatcccagcactttgggaggccaaggtgggcggatcgcctgaggtcaggagttcaagaccaacctgactaacatggtgaaaccccatctctactaaaaatacaaaattagccaggcatgatggcacatgcctgtaatcccagatacttgggaggctgaggcaggagaattgcttgaacccaggaggtggaggttgcagtgagctgagatcgtgccattgtgatatgaatatgccttatatgctgatatgaatatgccttaaaataaagtgttccccacccctg

SEQ ID NO: 29296 - DNA, 1300 bp, Homo sapiens
gtaggtcccggcaaccgcaggctcgcggcgggcgctgggcgcgggatccgactctagtcgtaatggaggcgggcggctttctggactcgctcatttacggagcatgcgtggtcttcacccttggcatgttctccgccggcctctcggacctcaggcacatgcgaatgacccggagtgtggacaacgtccagttcctgccctttctcaccacggaagtcaacaacctgggctggctgagttatggggctttgaagggagacgggatcctcatcgtcgtcaacacagtgggtgctgcgcttcagaccctgtatatcttggcatatctgcattactgccctcggaagcgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcccaggtgcagtgggttgtgggaacaagagatgactttgaggataaaaggaccaaagaaaaagctttacttagatgattgattggggcctaggagatgaaatcactttttattttttagagatttttttttttaattttggaggttggggtgcaatctttagaatatgccttaaaaggccgggcgcggtggctcacgcctgtaatcccagcactttgggaggccaaggtgggcggatcgcctgaggtcaggagttcaagaccaacctgactaacatggtgaaaccccatctctactaaaaatacaaaattagccaggcatgatggcacatgcctgtaatcccagatacttgggaggctgaggcaggagaattgcttgaacccaggaggtggaggttgcagtgagctgagatcgtgccattgtgatatgaatatgccttatatgctgatatgaatatgccttaaaataaagtgttccccacccctgcc

SEQ ID NO: 29297 - DNA, 886 bp, Homo sapiens
cgagagggagggcaaaagaggaaggcttggtgattcctggtaatgtgttattttgagaaaaagcttcggcagcacactccagaaaaaaacttcccaaaccctgggcaactgaggttctgatgtggagctctggatggaaagcgtgctgaagtcttgttaaactagcaagcttttgtttggaggtccaccgccgaaggcgcacaggcctgtgggaacacgagcgttgagactgggggcgtctagatgatccaaggggtaggcagagtgtgagcagcggcaggtatcggggacacacccgcggagccctaggaaggggactgaccgggacatggaagagctcggacctcaggcacatgcgaatgacccggagtgtggacaacgtccagttcctgccctttctcaccacggaagtcaacgtgttgtgctcctacagactgcaaccctgctaggggtccttctcctgggttatggctacttttggctcctggtacccaaccctgaggcccggcttcagcagttgggcctcttctgcagtgtcttcaccatcagcatgtacctctcaccactggctgacttggctaaggtgattcaaactaaatcaacccaatgtctctcctacccactcaccattgctacccttctcacctctgcctcctggtgcctctatgggtttcgactcagagatccctatatcatggtgtccaactttccaggaatcgtcaccagctttatccgcttctggcttttctggaagtacccccaggagcaagacaggaactactggctcctgcaaacctgaggctgctcatctgaccactgggcaccttagtgccaacctgaaccaaagagacctccttgtttcagctgggcctgctgtccagcttcc

SEQ ID NO: 29298 - DNA, 4521 bp, Homo sapiens
taggaacaggggagagtgcacctgctaccagtcaagctcagccagactgcaagaggaggcgaggcggagccagccgagggagtgaaccatggacaagttgaaatgcccgagtttcttcaagtgcagggagaaggagaaagtgtcggcttcatcagagaatttccatgttggtgaaaatgatgagaatcaggaccgtggtaactggtccaaaaaatcggattatcttctatctatgattggatacgcagtgggattaggaaatgtgtggagatttccatatctgacctacagcaatggtggaggcgccttcttgataccttatgcaattatgttagcattggctggtttacctttgttctttctggagtgttcactgggacaatttgctagcttaggtccagtttcagtttggaggattcttccattgtttcaaggtgtgggaattacaatggtcctgatctccatttttgtgacaatctattacaatgtcataattgcctatagtctttactacatgtttgcttcttttcaaagtgaactaccatggaaaaattgttcttcgtggtcagataaaaactgtagcagatcaccaatagtaactcactgtaatgtgagtacagtgaataaaggaatacaagagatcatccaaatgaataaaagctgggtagacatcaacaattttacctgcatcaacggcagtgaaatttatcagccagggcagcttcccagtgaacaatattggaataaagtggcgctccaacggtcaagtggaatgaatgagactggagtaattgtttggtatttagcactttgtcttcttctggcttggctcatagttggagcagcactatttaaaggaatcaaatcgtctggcaaggtggtatattttacagctcttttcccctatgtggtcctactcatcctgttagtacgaggtgcaactctggagggtgcttcaaaaggcatttcatactatattggagcccagtcaaattttacaaaacttaaggaagctgaggtatggaaagatgctgccactcagatattttactccctttcagtggcttggggtggcttagttgctctatcatcttacaataagttcaaaaacaactgcttctctgatgccattgtggtttgtttgacaaactgtctcactagcgtgtttgctggatttgctattttttctatattgggacacatggcccatatatctggaaaggaagtttctcaagttgtaaaatcaggttttgatttggcattcattgcctatccagaggctctagcccaactcccaggtggtccattttggtccatattattttttttcatgcttttaactttgggtctcgattctcagtttgcttcgattgaaacgatcacaacaacaattcaagatttatttcccaaagtgatgaagaaaatgagggttcccataactttgggctgctgcttggttttgtttctccttggtctcgtctgtgtgactcaggctggaatttactgggttcatctgattgaccacttctgtgctggatggggcattttaattgcagctatactggagctagttggaatcatctggatttatggagggaacagattcattgaggatacagaaatgatgattggagcaaagaggtggatattctggctatggtggagagcttgctggtttgtaattacgcctatccttttgattgcaatatttatctggtcattggtgcaatttcatagacctaattatggcgcaattccataccctgactggggagttgctttaggctggtgtatgattgttttctgcattatttggattccaattatggctatcataaaaataattcaggctaaaggaaacatctttcaacgccttataagttgctgcagaccagcttctaactggggtccatacctggaacaacatcgtggggaaagatataaagacatggtagatcctaaaaaagaggctgaccatgaaatacctactgttagtggcagcagaaaaccggaatgagatctcattgaaaaaaatatatgattgtataatgtgattttttttagaatagggggaaccttatttatttgtgtgttaactgaataggaaaatgtacatactatgttcatgatagtgtgatttttttcacatttaagcaggaatgcaatataaaaatgtgaatctcttaattctcagccatgtgcttattatatttctttttagattgtctatctgtataacacacacacacacacctaagagtctctatttcacaattatatttttgtaaatagtatatgcatttttaatacattggaggctttattttgaactaatttcttagagaatagttatattttctattacacaagtttaaaaatattattaacttgtattttcttaatatacaatctatcttttccacaaatatgagtgggaaataaatcagcacatttgaaagaaagtgttaaaactgaaggcctcacttaattagaaacgtgataaatatatggacaaatggactatacatactataagaggactgtagtttaatactttttacccaaatatgtttaaaaacttcgtgcatttgttacagctcatgttttctatatgaacttagtcattaatgttctttataaaaagtgaaataagatggaaaaataaggatcctacagccagtaagtgataaatctagaaaattgagttttgagtacctcttttcccatatacaatcttccttccttaggtaatttggaagaaaactatgacccatttaatttctattgtgtttcacaaaattaagtgttgttcattatactctctgaaatataggtttaatttcaaatagaatatggacttaaatgttaatgagaaaatggctttaatcaattctagcattttattactgtaatacagggctgatagagtgattttgtcttatatgagtaagttactacttacaggtgataacttgcatactattggaagataaacttgtcaaacttgtcaagaatgagaaaagccaaattagaaaatcctatgtcctagtttccttaccaaggataattaaatatatcactaagagctttatatattgattatatattgttgacaactggtttaagcatcatagcctatgatgataaacactgcctatatatgtaaatagcttttcatcaattcttaaatttcttaacctaggcttcagggagcatatgaaaccaaaattatatggaacattttctgtgtgtacatgtacatgcatttttctagggagagagtccgtaggtttatcagaatatcaaggaaaactgtgacccaaagaagtttaagaatcacatacagtgctgctggctttttgtgcttggcaaatgagtgacaatagaagaaataatttttcttacacattttaaaacgttttctcttccttgtgattgaagatgaaaggagtaagaaattaaggcatttgtttaatttatactggtaacttatttaggggggaggggacatgaaggtaggtaaataggtaggcctctaattgaaccacctctctaagttatgtacgtatatataagctgaaattgtgtttgacattctgagggttttctttttcttttttctttttttttttttttggtggggggctgggggtcagagtcttgttctgttgcctgggctggagtgcagtggcatgatctcagctcactgcaacctctgccttctggattcaagtgattctcctgcctcagcctcttgagtagctgggactacaggtgcccgccaccacaccagctaatttttgtatttttagtagaggcgaagtttccccatgttggccaggctggtcttgaactcccgacctcaagtgatctgtctacctcggcctcctaaagtgctgagattacaggtgtgagccaccgtgcccggcccattctaagggttttctttgaagacaggtcaaatgctgttagtaagtttcaggagattgttaattcctcagttataccagattttataaaatatttgagaatagatggctaacaagaggttagaaatacttttccttaattttaatccacagtatgttacatgcattctaccactacattttggtgctatttaaggtgtgcaattttctataggtgacttttgcaattcagggaagatttgggcatattaaatgaaagaatatctaattgggggaggtgtgaagggaaagaaattcttttcaaaagctgaccacaaagagtagttaaaagtttttgtcactatcttcacaagtgtgtaaagcacagatttcaacagagtgcttggcatattgtagggtgctcaatggtggtttttattattattactcagattccacagtggcaagaaacatcattctacataatggaaaacatttacatcaaatcccacttactttaatgcgaacttggagataatttatggtattgtattgtaaaccattaatgaaaactttttcacagttgagtgaaattaaaatcactatatctcaa

SEQ ID NO: 29299 - DNA, 3160 bp, Homo sapiens
aggttgtgtgctccttatgagaatctaactaacgcctgatgacctgaggtggaacggtttcatcttgaaactacccccaccccaaaatctgtggaaaaattgtcttccatgcgacaggtcactggtgctgaaaaggttggggaccgctgttctgcaggaaacgagagacagagggaatgggagtgcagtggtggagccacacccaaggagaggtggctgtggggctgggcctgggagactcctaccttaccccctgtccctgcccaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctgagcctgcctggaggagaaggaggaacccccatgccaatgtccaggtcacaggcatccgctgcgctcccacctcggacaccatcttgggattcctcccctggaagttgtcctttctgatcctctcttcttttcccatttacaaatgatttcgtgactgtagtttttgttcaccttctgtgcatctggcctgggggctgttagctcagaggagaggagcaaacaggaaaatgacttctgttctgtccccgctgttttgggggaagtctctcccactttgggatcctgctgaagctaggttcatgaggtcggaaatccccaccacatttgcctagactttgggcacaggagttcttagtccaccaaatcagagagaggatgggcttttgatcagatacccctcccaaaaaaaaaaaaaactaaaactaaagcaaaaatcaaacaaaatctggctgagtttagtggggtggttggggaaggtacatagaccctcctcttgcccaccctagacagccctctcatgtctgaacctcagcctgggagttagatttatttgtctctaaaatgaagtcagtggatagatgctttgagggattttgagtagaaacattcatagttaattttcactctggccaatctgagtttgatgtgtgtgttctggaacattcctccagcttttggtggtcagatggcccagagatatgggggacaggaggaagagggtaaatgaaccacagtgagcaggttctaggaggtacctgcatcagacaagctggtggaggccacgtggcaagccacatctactgaggcctcatgctgctcttgctctgtaagacacggagcccagaaacccatctgcacttcctgagacctgcctggggaaacgggggcagggaccaagtgaggcctcatgtgtgtcttcaccgtgctgtcctcacaaggccaggtgggtgcccaaagggagcctgacaggctgttgtgttaatttattgttcttgcacacctgcacagcctccctctggggatcccacctggagtggaccaggggtcttgagaaatggagagttggctgcaaaaactctcatgcactagatgtggcaccttggagggcagggtgagacaagcagcccagaaatactctctcaagtggaggggagaattttgagagtggatggaacagtttggtggtttcagagaatttctaggtttctacttggatctacttctgatacaaacttgcacttggtgccctctggtggtgtttagttttagttccgtaagagaaatgattcctagtttgctaaattggtggcatctttgggaggggtttctgtttatggttagagtctcttacacccttgttggagggattcttattctgactgtgggagctcctgttgcgggatcttgggaaaaaataaagaagccgctgcattcgcacgtcaagaa

SEQ ID NO: 29300 - DNA, 3165 bp, Homo sapiens
agtgattagcctgtggagcaggaaagtccagcgatgggcagctggtcacggcagtgggtgaaagcaggggtggtcatctgacgaggggaggggaagcaggtggtgcccagcaaggtggaaggagaagtggacaggagaaacctcggggcattcccgagggcccaggaactgcaataaatgatcacagggaaacttagagttcagagagggggtgtgatttgcctgaggtcacacagcaagttagagacccagctccacgactcattgtcttggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctggcatctgtggtcatcgagtcatatttgaatgtctactacatcatcatccttgcctgggctctcttctacctgttcagctccttcacttctgagctgccctggacgacctgcaacaacttttggaacacagagcattgcacggactttctgaaccactcaggagccggcacagtgaccccatttgagaattttacctcacctgtcatggaattctgggagagacgagttctgggcatcacctcgggcatccatgacctgggctccctgcgctgggagctggccctgtgcctcctgctcgcctgggtcatctgctatttctgcatctggaagggggtcaagtccacaggcaaggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaacaactgctacaaggactgcatcgccctctgcttcctgaacagtgccaccagctttgtggctgggtttgttgtcttctccatcctgggcttcatgtcccaagagcaaggggtgcccatttctgaagtggccgagtcaggtcctgggctggccttcatcgccttccccaaggctgtgactatgatgcccttatcccagctgtggtcctgcctgttctttatcatgctcatattcctagggctggacagccagtttgtctgtgtggagtgcctggtgacagcctccatagacatgttccccaggcagctccggaagagcgggcggcgcgagctcctcatcctcaccatcgccgtcatgtgctacctgatagggcttttcctggtcaccgagggcgggatgtacatcttccagctgtttgactactatgcttccagtggcatatgcctgctgttcctgtcattgtttgaagtggtctgcataagctgggtgtatggggcggaccgtttctatgacaacattgaggacatgattggctaccggccatggcccctggtgaagatctcctggctcttcctgacccctggactttgcctggccactttcctcttctccttgagcaagtacacccccctcaagtacaacaacgtctatgtgtacccgccctggggatactccattggctggttcctggctctgtcctccatggtctgtgtcccactcttcgtcgtcatcaccctcctgaagactcggggtcctttcaggaagcgtctgcgtcagctcatcacccctgactccagtctgccacagcccaagcaacatccctgcttggatggcagtgctggccggaactttgggccctccccaacaagggaaggactgatagccggggagaaggagacccatttgtagggtgtggccagaggccaggcggctcctaagccgggaacctaggtcagggccaccctccattctcagcggacagcctctgcctctgtctcctgccacaatcctgctgggaacctctggagagccacaggcacccccagctggaggccagactcctctcttgtgctagctggagcagctccttcccctttgctgataacaccaccactgggacgtgccatgttgggacgccactccctgtgggaaggcaccatcgtttttataaaggggggtctttttggaggccgccatctgattgcaacacctcgagttatgaggattccactgtggggatgcctcttgttagagcgtactgcatttgtacacggggagaggagctataattggaacgcacactgccgtccaatgtggagagcctgatgggacaataccctgttggaagtgacaactgaacacactgtgttggatcggaggttccgttaggggatccttccttaggcttaacgacagaggcaagcctttgcatgccgtcagtctggagtttcctccgagtctctcatggcatctccagctcctgccctagttccgcactgttcttgcagtgtttcatcaactcctggagcattggaatggaaggggcttgggagatgattcctagacttcacaaacactcggcatgcctccctgcactgtccgttcctctgcccaaggccgatattgctaactgatcacagattctttcccacctcacaatccttccgaatgtgctccaggcagcaccatttgccatcctgcttctaacgcaaacccctgacttcatggatgaggaacctggagaccaaagagacaaagggactttttcaagttcacatggggacccccttcttgggggccagagatatgactaaaaccttatctccttgtgctcaggccagtgtcttcccattaaccccctgccttagttaacaagtgtgtatggattgccttccatgcg

SEQ ID NO: 29301 - DNA, 3285 bp, Homo sapiens
gttcagaggccccaccttctcttttcctcccaatcagctgcccagagctgctggctcccctgtttactctgagctgatcgatcaccttagcacacagctggctaggagagaaccatgcagtcacttcggccacacctgcccgttgacccttgctacctcggcaggctttgatcccttctgacctggaggccagaggctaggctgaggtcactcagcagacatcaaggacctgggcagatgggccggctgggatggtggcgagctgtacagataaaaagggacatgaaaatgaaaagcccgagcctgagttttcatcacggttccactcctgagtggtcttgggtgaatcacttcatctgccaaggcctggatttcctcatctgcaaactcagaaaactaaggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctggcatctgtggtcatcgagtcatatttgaatgtctactacatcatcatccttgcctgggctctcttctacctgttcagctccttcacttctgagctgccctggacgacctgcaacaacttttggaacacagagcattgcacggactttctgaaccactcaggagccggcacagtgaccccatttgagaattttacctcacctgtcatggaattctgggagagacgagttctgggcatcacctcgggcatccatgacctgggctccctgcgctgggagctggccctgtgcctcctgctcgcctgggtcatctgctatttctgcatctggaagggggtcaagtccacaggcaaggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaacaactgctacaaggactgcatcgccctctgcttcctgaacagtgccaccagctttgtggctgggtttgttgtcttctccatcctgggcttcatgtcccaagagcaaggggtgcccatttctgaagtggccgagtcaggtcctgggctggccttcatcgccttccccaaggctgtgactatgatgcccttatcccagctgtggtcctgcctgttctttatcatgctcatattcctagggctggacagccagtttgtctgtgtggagtgcctggtgacagcctccatagacatgttccccaggcagctccggaagagcgggcggcgcgagctcctcatcctcaccatcgccgtcatgtgctacctgatagggcttttcctggtcaccgagggcgggatgtacatcttccagctgtttgactactatgcttccagtggcatatgcctgctgttcctgtcattgtttgaagtggtctgcataagctgggtgtatggggcggaccgtttctatgacaacattgaggacatgattggctaccggccatggcccctggtgaagatctcctggctcttcctgacccctggactttgcctggccactttcctcttctccttgagcaagtacacccccctcaagtacaacaacgtctatgtgtacccgccctggggatactccattggctggttcctggctctgtcctccatggtctgtgtcccactcttcgtcgtcatcaccctcctgaagactcggggtcctttcaggaagcgtctgcgtcagctcatcacccctgactccagtctgccacagcccaagcaacatccctgcttggatggcagtgctggccggaactttgggccctccccaacaagggaaggactgatagccggggagaaggagacccatttgtagggtgtggccagaggccaggcggctcctaagccgggaacctaggtcagggccaccctccattctcagcggacagcctctgcctctgtctcctgccacaatcctgctgggaacctctggagagccacaggcacccccagctggaggccagactcctctcttgtgctagctggagcagctccttcccctttgctgataacaccaccactgggacgtgccatgttgggacgccactccctgtgggaaggcaccatcgtttttataaaggggggtctttttggaggccgccatctgattgcaacacctcgagttatgaggattccactgtggggatgcctcttgttagagcgtactgcatttgtacacggggagaggagctataattggaacgcacactgccgtccaatgtggagagcctgatgggacaataccctgttggaagtgacaactgaacacactgtgttggatcggaggttccgttaggggatccttccttaggcttaacgacagaggcaagcctttgcatgccgtcagtctggagtttcctccgagtctctcatggcatctccagctcctgccctagttccgcactgttcttgcagtgtttcatcaactcctggagcattggaatggaaggggcttgggagatgattcctagacttcacaaacactcggcatgcctccctgcactgtccgttcctctgcccaaggccgatattgctaactgatcacagattctttcccacctcacaatccttccgaatgtgctccaggcagcaccatttgccatcctgcttctaacgcaaacccctgacttcatggatgaggaacctggagaccaaagagacaaagggactttttcaagttcacatggggacccccttcttgggggccagagatatgactaaaaccttatctccttgtgctcaggccagtgtcttcccattaaccccctgccttagttaacaagtgtgtatggattgcc

SEQ ID NO: 29302 - DNA, 3332 bp, Homo sapiens
gggtgtgaaggactacagagagagccaggttttggtgccatgcacacagggaaacttagagttcagagagggggtgtgatttgcctgaggtcacacagcaagttagagacccagctccacgactcattgtcttgctgcccagagctgctggctcccctgtttactctgagctgatcgatcaccttagcacacagctggctaggagagaaccatgcagtcacttcggccacacctgcccgttgacccttgctacctcggcaggctttgatcccttctgacctggaggccagaggctaggctgaggtcactcagcagacatcaaggacctgggcagatgggccggctgggatggtggcgagctgtacagataaaaagggacatgaaaatgaaaagcccgagcctgagttttcatcacggttccactcctgagtggtcttgggtgaatcacttcatctgccaaggcctggatttcctcatctgcaaactcagaaaactaaggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctggcatctgtggtcatcgagtcatatttgaatgtctactacatcatcatccttgcctgggctctcttctacctgttcagctccttcacttctgagctgccctggacgacctgcaacaacttttggaacacagagcattgcacggactttctgaaccactcaggagccggcacagtgaccccatttgagaattttacctcacctgtcatggaattctgggagagacgagttctgggcatcacctcgggcatccatgacctgggctccctgcgctgggagctggccctgtgcctcctgctcgcctgggtcatctgctatttctgcatctggaagggggtcaagtccacaggcaaggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaacaactgctacaaggactgcatcgccctctgcttcctgaacagtgccaccagctttgtggctgggtttgttgtcttctccatcctgggcttcatgtcccaagagcaaggggtgcccatttctgaagtggccgagtcaggtcctgggctggccttcatcgccttccccaaggctgtgactatgatgcccttatcccagctgtggtcctgcctgttctttatcatgctcatattcctagggctggacagccagtttgtctgtgtggagtgcctggtgacagcctccatagacatgttccccaggcagctccggaagagcgggcggcgcgagctcctcatcctcaccatcgccgtcatgtgctacctgatagggcttttcctggtcaccgagggcgggatgtacatcttccagctgtttgactactatgcttccagtggcatatgcctgctgttcctgtcattgtttgaagtggtctgcataagctgggtgtatggggcggaccgtttctatgacaacattgaggacatgattggctaccggccatggcccctggtgaagatctcctggctcttcctgacccctggactttgcctggccactttcctcttctccttgagcaagtacacccccctcaagtacaacaacgtctatgtgtacccgccctggggatactccattggctggttcctggctctgtcctccatggtctgtgtcccactcttcgtcgtcatcaccctcctgaagactcggggtcctttcaggaagcgtctgcgtcagctcatcacccctgactccagtctgccacagcccaagcaacatccctgcttggatggcagtgctggccggaactttgggccctccccaacaagggaaggactgatagccggggagaaggagacccatttgtagggtgtggccagaggccaggcggctcctaagccgggaacctaggtcagggccaccctccattctcagcggacagcctctgcctctgtctcctgccacaatcctgctgggaacctctggagagccacaggcacccccagctggaggccagactcctctcttgtgctagctggagcagctccttcccctttgctgataacaccaccactgggacgtgccatgttgggacgccactccctgtgggaaggcaccatcgtttttataaaggggggtctttttggaggccgccatctgattgcaacacctcgagttatgaggattccactgtggggatgcctcttgttagagcgtactgcatttgtacacggggagaggagctataattggaacgcacactgccgtccaatgtggagagcctgatgggacaataccctgttggaagtgacaactgaacacactgtgttggatcggaggttccgttaggggatccttccttaggcttaacgacagaggcaagcctttgcatgccgtcagtctggagtttcctccgagtctctcatggcatctccagctcctgccctagttccgcactgttcttgcagtgtttcatcaactcctggagcattggaatggaaggggcttgggagatgattcctagacttcacaaacactcggcatgcctccctgcactgtccgttcctctgcccaaggccgatattgctaactgatcacagattctttcccacctcacaatccttccgaatgtgctccaggcagcaccatttgccatcctgcttctaacgcaaacccctgacttcatggatgaggaacctggagaccaaagagacaaagggactttttcaagttcacatggggacccccttcttgggggccagagatatgactaaaaccttatctccttgtgctcaggccag

SEQ ID NO: 29303 - DNA, 3571 bp, Homo sapiens
atacccgtctcctcatccctgggaaggagatggttctggagggggataggggaaaagggggaagggggaagggcaaggaggaggaggaggggagatgaggtcagggtgtgagtctctgagccccttcccctgcccaagggagcagcagctcagcccagctctggaggggccatcatgggactgtgcccacggggagggcaccggtctggagacagtgggttcacagtgggagtgggatgggggtgggagcgctggggacagaggacttgacttcctgaggttggatgttgtaatctcggttcacaaacttttggcctcagtccctcctgctgctcctggtatttctctgtcctttcactccccaacacacacagcccccgccccaacacatacacacacggcttctttctgtctgggagtccctggacaagtcacatgggattctgcgctgggaggaacagggtaaggcgtgaacgtggagggcagtttccctttcaggtcccggctctcttggctttcccataagcagctgccttgggactctcctggagacctgatgcccacagccaagctgaccacaggagccggtgctggggactgagggaaacttagagttcagagagggggtgtgatttgcctgaggtcacacagcaagttagagacccagctccacgactcattgtcttggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctggcatctgtggtcatcgagtcatatttgaatgtctactacatcatcatccttgcctgggctctcttctacctgttcagctccttcacttctgagctgccctggacgacctgcaacaacttttggaacacagagcattgcacggactttctgaaccactcaggagccggcacagtgaccccatttgagaattttacctcacctgtcatggaattctgggagagacgagttctgggcatcacctcgggcatccatgacctgggctccctgcgctgggagctggccctgtgcctcctgctcgcctgggtcatctgctatttctgcatctggaagggggtcaagtccacaggcaaggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaacaactgctacaaggactgcatcgccctctgcttcctgaacagtgccaccagctttgtggctgggtttgttgtcttctccatcctgggcttcatgtcccaagagcaaggggtgcccatttctgaagtggccgagtcaggtcctgggctggccttcatcgccttccccaaggctgtgactatgatgcccttatcccagctgtggtcctgcctgttctttatcatgctcatattcctagggctggacagccagtttgtctgtgtggagtgcctggtgacagcctccatagacatgttccccaggcagctccggaagagcgggcggcgcgagctcctcatcctcaccatcgccgtcatgtgctacctgatagggcttttcctggtcaccgagggcgggatgtacatcttccagctgtttgactactatgcttccagtggcatatgcctgctgttcctgtcattgtttgaagtggtctgcataagctgggtgtatggggcggaccgtttctatgacaacattgaggacatgattggctaccggccatggcccctggtgaagatctcctggctcttcctgacccctggactttgcctggccactttcctcttctccttgagcaagtacacccccctcaagtacaacaacgtctatgtgtacccgccctggggatactccattggctggttcctggctctgtcctccatggtctgtgtcccactcttcgtcgtcatcaccctcctgaagactcggggtcctttcaggaagcgtctgcgtcagctcatcacccctgactccagtctgccacagcccaagcaacatccctgcttggatggcagtgctggccggaactttgggccctccccaacaagggaaggactgatagccggggagaaggagacccatttgtagggtgtggccagaggccaggcggctcctaagccgggaacctaggtcagggccaccctccattctcagcggacagcctctgcctctgtctcctgccacaatcctgctgggaacctctggagagccacaggcacccccagctggaggccagactcctctcttgtgctagctggagcagctccttcccctttgctgataacaccaccactgggacgtgccatgttgggacgccactccctgtgggaaggcaccatcgtttttataaaggggggtctttttggaggccgccatctgattgcaacacctcgagttatgaggattccactgtggggatgcctcttgttagagcgtactgcatttgtacacggggagaggagctataattggaacgcacactgccgtccaatgtggagagcctgatgggacaataccctgttggaagtgacaactgaacacactgtgttggatcggaggttccgttaggggatccttccttaggcttaacgacagaggcaagcctttgcatgccgtcagtctggagtttcctccgagtctctcatggcatctccagctcctgccctagttccgcactgttcttgcagtgtttcatcaactcctggagcattggaatggaaggggcttgggagatgattcctagacttcacaaacactcggcatgcctccctgcactgtccgttcctctgcccaaggccgatattgctaactgatcacagattctttcccacctcacaatccttccgaatgtgctccaggcagcaccatttgccatcctgcttctaacgcaaacccctgacttcatggatgaggaacctggagaccaaagagacaaagggactttttcaagttcacatggggacccccttcttgggggccagagatatgactaaaaccttatctccttgtgctcaggccagtgtcttcccattaaccccctgccttagttaacaagtgtgtatggattgcc

SEQ ID NO: 29304 - DNA, 2101 bp, Homo sapiens
tctttctgtctgggagtccctggacaagtcacatgggattctgcgctgggaggaacagggtaaggcgtgaacgtggagggcagtttccctttcaggtcccggctctcttggctttcccataagcagctgccttgggactctcctggagacctgatgcccacagccaagctgaccacaggagccggtgctggggactgaggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctggcatctgtggtcatcgagtcatatttgaatgtctactacatcatcatccttgcctgggctctcttctacctgttcagctccttcacttctgagctgccctggacgacctgcaacaacttttggaacacagagcattgcacggactttctgaaccactcaggagccggcacagtgaccccatttgagaattttacctcacctgtcatggaattctgggagagacgagttctgggcatcacctcgggcatccatgacctgggctccctgcgctgggagctggccctgtgcctcctgctcgcctgggtcatctgctatttctgcatctggaagggggtcaagtccacaggcaaggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaacaactgctacaaggactgcatcgccctctgcttcctgaacagtgccaccagctttgtggctgggtttgttgtcttctccatcctgggcttcatgtcccaagagcaaggggtgcccatttctgaagtggccgagtcaggtcctgggctggccttcatcgccttccccaaggctgtgactatgatgcccttatcccagctgtggtcctgcctgttctttatcatgctcatattcctagggctggacagccagtttgtctgtgtggagtgcctggtgacagcctccatagacatgttccccaggcagctccggaagagcgggcggcgcgagctcctcatcctcaccatcgccgtcatgtgctacctgatagggcttttcctggtcaccgagggcgggatgtacatcttccagctgtttgactactatgcttccagtggcatatgcctgctgttcctgtcattgtttgaagtggtctgcataagctgggtgtatggggcggaccgtttctatgacaacattgaggacatgattggctaccggccatggcccctggtgaagatctcctggctcttcctgacccctggactttgcctggccactttcctcttctccttgagcaagtacacccccctcaagtacaacaacgtctatgtgtacccgccctggggatactccattggctggttcctggctctgtcctccatggtctgtgtcccactcttcgtcgtcatcaccctcctgaagactcggggtcctttcaggaagcgtctgcgtcagctcatcacccctgactccagtctgccacagcccaagcaacatccctgcttggatggcagtgctggccggaactttgggccctccccaacaagggaaggactgatagccggggagaaggagacccatttgtag

SEQ ID NO: 29305 - DNA, 577 bp, Homo sapiens
atccctgtttctctagagccttggaggagcgtggggcacttggtagacctggtcgctttgattccctcaatacccctcagaggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctggcatctgtggtcatcgagtcatatttgaatgtctactacatcatcatccttgcctgggctctcttctacctgttcagc

SEQ ID NO: 29306 - DNA, 3763 bp, Homo sapiens
gcctccgcgggccccggccggggcggggggcgcgggccacaggcccctgctccggccgccgcttgcagaccgcgggcgccgatgtcgcccgcgccccgctaggctgagcctcgggtcgggcgaggagccgccgcagccgccgccgcccgagccgcgggcaggagcctcgggagccgccgccgccgccgccgccgcccggccgggccccgccgccgcccgcgcgcccccgggcccccgacacacatgagattcttcaggctcactttcaagtgcttcgtggactgcttctgactgcgccgcccgcgccccgcaccccgccgcccgcccgccgccccgtcccccggcccggccgccccccggcccccggccggcccgcgccctcggggccctccccggtgccgccggtgccccccgcctgaccgccgccccccgtgaggcgccgcgaccccggcccggccgtgcggcccgccgaggccatggcgaagaagagcgccgagaacggcatctatagcgtgtccggcgacgagaagaagggccccctcatcgcgcccgggcccgacggggccccggccaagggcgacggccccgtgggcctggggacacccggcggccgcctggccgtgccgccgcgcgagacctggacgcgccagatggacttcatcatgtcgtgcgtgggcttcgccgtgggcttgggcaacgtgtggcgcttcccctacctgtgctacaagaacggcggaggtgtgttccttattccctacgtcctgatcgccctggttggaggaatccccattttcttcttagagatctcgctgggccagttcatgaaggccggcagcatcaatgtctggaacatctgtcccctgttcaaaggcctgggctacgcctccatggtgatcgtcttctactgcaacacctactacatcatggtgctggcctggggcttctattacctggtcaagtcctttaccaccacgctgccctgggccacatgtggccacacctggaacactcccgactgcgtggagatcttccgccatgaagactgtgccaatgccagcctggccaacctcacctgtgaccagcttgctgaccgccggtcccctgtcatcgagttctgggagaacaaagtcttgaggctgtctgggggactggaggtgccaggggccctcaactgggaggtgaccctttgtctgctggcctgctgggtgctggtctacttctgtgtctggaagggggtcaaatccacgggaaagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgtggatagatgcggggacccagattttcttttcttacgccattggcctgggggccctcacagccctgggcagctacaaccgcttcaacaacaactgctacaaggacgccatcatcctggctctcatcaacagtgggaccagcttctttgctggcttcgtggtcttctccatcctgggcttcatggctgcagagcagggcgtgcacatctccaaggtggcagagtcagggccgggcctggccttcatcgcctacccgcgggctgtcacgctgatgccagtggccccactctgggctgccctgttcttcttcatgctgttgctgcttggtctcgacagccagtttgtaggtgtggagggcttcatcaccggcctcctcgacctcctcccggcctcctactacttccgtttccaaagggagatctctgtggccctctgttgtgccctctgctttgtcatcgatctctccatggtgactgatggcgggatgtacgtcttccagctgtttgactactactcggccagcggcaccaccctgctctggcaggccttttgggagtgcgtggtggtggcctgggtgtacggagctgaccgcttcatggacgacattgcctgtatgatcgggtaccgaccttgcccctggatgaaatggtgctggtccttcttcaccccgctggtctgcatgggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctgggggaggaggggagaaagcaccatgagtgctcactaaaacaactttttccatttttaataaaacgccaaaaatatcacaacccaccaaaaatagatgcctctccccctccagccctagccgagctggtcctaggccccgcctagtgccccacccccacccacagtgctgcactcctcctgcccctgccacgcccaccccctgcccacctctccaggctctgctctgcagcacacccgtgggtgacccctcaccccagaagcagcagtggcagcttgggaaatgtgaggaagggaaggagggagagacgggagggaggagagagaggagaagggaggcaggggaggggcagcagaaccaaggcaaatatttcagctgggctatacccctctccccatccctgttatagaagcttagagagccagccagcaatggaaccttctggttcctgcgccaatcgccaccagtatcaattgtgtgagcttgggtgcgagtgcacgcgtgcgtgagtacggagagtatatatagatctctatctcttagcaaaggtgaatgccagatgtaaatggcgcctctgggcaaaggaggcttgtattttgcacattttataaaaacttgagagaatgagatttctgcttgtatatttctaaaaagaggaaggagcccaaaccatcctctccttaccactcccatccctgtgagccctaccttacccctctgcccctagccaaggagtgtgaatttatagatctaactttcataggcaaaacaaaagcttcgagctgttgcgtgtgtgagtctgttgtgtggatgtgcgtgtgtggtccccagccccagactggattggaaaagtgcatggtgggggcctcggggctgtccccacgctgtccctttgccacaagtctgtggggcaagaggctgcaatattccgtcctgggtgtctgggctgctaacctggcctgctcaggcttcccaccctgtgcggggcacacccccaggaagggaccctggacacggctcccacgtccaggcttaaggtggatgcacttcccgcacctccagtcttctgtgtagcagctttaacccacgtttgtctgtcacgtccagtcccgagacggctgagtgaccccaagaaaggcttccccgacacccagacagaggctgcagggctggggctgggtgagggtggcgggcctgcggggacattctactgtgctaaaaagccactgcagacatagcaataaaaacatgtcattttccaaagcagg

SEQ ID NO: 29307 - DNA, 2390 bp, Homo sapiens
ctgaaagccaagcaatgctccccaccctgcaaatccagggcccagcagcctttgctcctggggatagaggccctggcaggcactgtcccttccctgtgcccatcacccccactggtgccctcctgccagtctctgactcttgtgacagtctggtggacctggtctggccatctgttacctatcttgccttggggacccagagcagagtctggccacatcccttgggggctcctggtcaggctggggagtcacctgaacaaagaagacagtgtctagagctgtgggacatggccagctccctgggggacaaggtccccagagcagcatgtgggaagagggggcagacagtgtggcagctgcatctcgcctgcctctgcctggcccagttccactctccacctgctcaacccccacctctctccagaagaggagggggacccgacccggatccaatatcccgctccctgcctgggcctcccacacctgcactgcccacacactcatacagctctcactccccacgtgctccacgcctcctgtccccactgaggagagctcccagaggctcgcctgctccccaccgacacgcgtccctgcagacaaacgaggcgcccagggagcttccccactgcacttggccagggctgccggggcgcagccttgcccctagcttcctctggcgggagccatggctcggaggacaatggggacctctgaacatacctgcccgcaagggggaccggaggcgctgggagtgggggtgtgagggaggtggtgccacagcctccgctgagcagcctggcccccagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgtggatagatgcggggacccagattttcttttcttacgccattggcctgggggccctcacagccctgggcagctacaaccgcttcaacaacaactgctacaaggacgccatcatcctggctctcatcaacagtgggaccagcttctttgctggcttcgtggtcttctccatcctgggcttcatggctgcagagcagggcgtgcacatctccaaggtggcagagtcagggccgggcctggccttcatcgcctacccgcgggctgtcacgctgatgccagtggccccactctgggctgccctgttcttcttcatgctgttgctgcttggtctcgacagccaggtttgcatggggctctgggacagggagccaggaggggggcggagggagggctgcaggcaaggaaaggggtggaggcggtgcggggctcggcctgagctgccctggccacagtttgtaggtgtggagggcttcatcaccggcctcctcgacctcctcccggcctcctactacttccgtttccaaagggagatctctgtggccctctgttgtgccctctgctttgtcatcgatctctccatggtgactgatgtgagtggggtggggggtctgcctgtgacctctggtggccgtctgccatcctccctgactgggctctgtccccagggcgggatgtacgtcttccagctgtttgactactactcggccagcggcaccaccctgctctggcaggccttttgggagtgcgtggtggtggcctgggtgtacggtaggtcatggctgagggctgggctgggggatggtggcggggaaggcaggtctccagcttggcccgcctcacctcgcggagctgaccgcttcatggacgacattgcctgtatgatcgggtaccgaccttgcccctggatgaaatggtgctggtccttcttcaccccgctggtctgcatgggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctgggggaggaggggagaaagcaccatgagtgctcactaaaacaactttttccatttttaataaaacgccaaaaat

SEQ ID NO: 29308 - DNA, 468 bp, Homo sapiens
ctgctacattcccctacgtggtcctggtcgtgctgctggtgcgtggagtgctgctgcctggcgccctggatggcatcatttactatctcaagcctgactggtcaaagctggggtcccctcagccctgggcagctacaaccgcttcaacaacaactgctacaatgggaccagcttctttgctggcttcgtggtcttctccatcctgggcttcatggctgcagagcagggcgtgcacatctccaaggtggcagagtcagggagatctctgtggccctctgttgtgccctctgctttgtcatcgatctctccatggtgactgatggcgggatgtacgtcttccagctgtttgactactactcggccagcggcaccaccctgctctggcaggccttttgggagtgcgtggtggtggcctgggtgtacggagctgaccgcttcatggacgacattgcctgtatgatcgggtac

SEQ ID NO: 29309 - DNA, 334 bp, Homo sapiens
cttccgccatgaagactgtgccaatgccagcctggccaacctcacctgtgaccagcttgctgaccgccggtcccctgtcatcgagttctgggagaacaaagtcttgaggctgtctgggggactggaggtgccaggggccctcaactgggaggtgaccctttgtctgctggcctgctgggtgctggtctacttctgtgtctggaagggggtcaaatccacgggaaaggtaccactagaggcatgcagcggggagggtggctcagccctgggagccggatgtctgtgccaggcacacctgtggcaacgggaggtgaccagacagagtctagcccta

SEQ ID NO: 29310 - DNA, 1892 bp, Homo sapiens
gtgtgtcctgtgactacaaaacagcactggggttgctggaagccgaagtgacccggtgatgggtgggaaacagaggtccagagcaaaggcctttgcccaaggtcaggagaaggatgctgggacctggagtcaggtgtgttccttattccctacgtcctgatcgccctggttggaggaatccccattttcttcttagagatctcgctgggccagttcatgaaggccggcagcatcaatgtctggaacatctgtcccctgttcaaaggcctgggctacgcctccatggtgatcgtcttctactgcaacacctactacatcatggtgctggcctggggcttctattacctggtcaagtcctttaccaccacgctgccctgggccacatgtggccacacctggaacactcccgactgcgtggagatcttccgccatgaagactgtgccaatgccagcctggccaacctcacctgtgaccagcttgctgaccgccggtcccctgtcatcgagttctgggagaacaaagtcttgaggctgtctgggggactggaggtgccaggggccctcaactgggaggtgaccctttgtctgctggcctgctgggtgctggtctacttctgtgtctggaagggggtcaaatccacgggaaagatcgtgtacttcactgctacattcccctacgtggtcctggtcgtgctgctggtgcgtggagtgctgctgcctggcgccctggatggcatcatttactatctcaagcctgactggtcaaagctggggtcccctcaggtgtggatagatgcggggacccagattttcttttcttacgccattggcctgggggccctcacagccctgggcagctacaaccgcttcaacaacaactgctacaaggacgccatcatcctggctctcatcaacagtgggaccagcttctttgctggcttcgtggtcttctccatcctgggcttcatggctgcagagcagggcgtgcacatctccaaggtggcagagtcagggccgggcctggccttcatcgcctacccgcgggctgtcacgctgatgccagtggccccactctgggctgccctgttcttcttcatgctgttgctgcttggtctcgacagccagtttgtaggtgtggagggcttcatcaccggcctcctcgacctcctcccggcctcctactacttccgtttccaaagggagatctctgtggccctctgttgtgccctctgctttgtcatcgatctctccatggtgactgatggcgggatgtacgtcttccagctgtttgactactactcggccagcggcaccaccctgctctggcaggccttttgggagtgcgtggtggtggcctgggtgtacggagctgaccgcttcatggacgacattgcctgtatgatcgggtaccgaccttgcccctggatgaaatggtgctggtccttcttcaccccgctggtctgcatgggcatcttcatcttcaacgttgtgtactacgagccgctggtctacaacaacacctacgtgtacccgtggtggggtgaggccatgggctgggccttcgccctgtcctccatgctgtgcgtgccgctgcacctcctgggctgcctcctcagggccaagggcaccatggctgagcgctggcagcacctgacccagcccatctggggcctccaccacttggagtaccgagctcaggacgcagatgtcaggggcctgaccaccctgaccccagtgtccgagagcagcaaggtcgtcgtggtggagagtgtcatgtgacaactcagctcacatcaccagctcacctctggtagccatagcagcccctgcttcagccccaccgcacccctccagggggcctgcctttccctgacacttttggggtctgcctg

SEQ ID NO: 29311 - DNA, 523 bp, Homo sapiens
ggatagatgcggggacccagattttcttttcttacgccattggcctgggggccctcacagccctgggcagctacaaccgcttcaacaacaactgctacaatgggaccagcttctttgctggcttcgtggtcttctccatcctgggcttcatggctgcagagcagggcgtgcacatctccaaggtggcagagtcagggccgggcctggccttcatcgcctacccgcgggctgtcacgctgatgccagtggccccactctgggctgccctgttcttcttcatgctgttgctgcttggtctcgacagccagtttgtaggtgtggagggcttcatcaccggcctcctcgacctcctcccggcctcctactacttccgtttccaaagggagatctctgtggccctctgttgtgccctctgctttgtcatcgatctctccatggtgactgatggcgggatgtacgtcttccagctgtttgactactactcggccagcggcaccaccctgctctggcaggccttttggga

SEQ ID NO: 29312 - DNA, 266 bp, Homo sapiens
ggacgccatcatcctggctctcatcaacagtgggaccagcttctttgctggcttcgtggtcttctccatcctgggcttcatggctgcagagcagggcgtgcacatctccaaggtggcagagtcagggccgggcctggccttcatcgcctacccgcgggctgtcacgctgatgccagtggccccactctgggctgccctgttcttcttcatgctgttgctgcttggtctcgacagccaggtgtggagggcttcatcaccggcctcct

SEQ ID NO: 29313 - DNA, 3932 bp, Homo sapiens
agcgctgcggagcgggaggggaggcttcgcggaacgctctcggcgccaggactcgcgtgcaaagcccaggcccgggcggccagaccaagagggaagaagcacagaattcctcaactcccagtgtgcccatgagtaagagcaaatgctccgtgggactcatgtcttccgtggtggccccggctaaggagcccaatgccgtgggcccgaaggaggtggagctcatccttgtcaaggagcagaacggagtgcagctcaccagctccaccctcaccaacccgcggcagagccccgtggaggcccaggatcgggagacctggggcaagaagatcgactttctcctgtccgtcattggctttgctgtggacctggccaacgtctggcggttcccctacctgtgctacaaaaatggtggcggtgccttcctggtcccctacctgctcttcatggtcattgctgggatgccacttttctacatggagctggccctcggccagttcaacagggaaggggccgctggtgtctggaagatctgccccatactgaaaggtgtgggcttcacggtcatcctcatctcactgtatgtcggcttcttctacaacgtcatcatcgcctgggcgctgcactatctcttctcctccttcaccacggagctcccctggatccactgcaacaactcctggaacagccccaactgctcggatgcccatcctggtgactccagtggagacagctcgggcctcaacgacacttttgggaccacacctgctgccgagtactttgaacgtggcgtgctgcacctccaccagagccatggcatcgacgacctggggcctccgcggtggcagctcacagcctgcctggtgctggtcatcgtgctgctctacttcagcctctggaagggcgtgaagacctcagggaaggtggtatggatcacagccaccatgccatacgtggtcctcactgccctgctcctgcgtggggtcaccctccctggagccatagacggcatcagagcatacctgagcgttgacttctaccggctctgcgaggcgtctgtttggattgacgcggccacccaggtgtgcttctccctgggcgtggggttcggggtgctgatcgccttctccagctacaacaagttcaccaacaactgctacagggacgcgattgtcaccacctccatcaactccctgacgagcttctcctccggcttcgtcgtcttctccttcctggggtacatggcacagaagcacagtgtgcccatcggggacgtggccaaggacgggccagggctgatcttcatcatctacccggaagccatcgccacgctccctctgtcctcagcctgggccgtggtcttcttcatcatgctgctcaccctgggtatcgacagcgccatgggtggtatggagtcagtgatcaccgggctcatcgatgagttccagctgctgcacagacaccgtgagctcttcacgctcttcatcgtcctggcgaccttcctcctgtccctgttctgcgtcaccaacggtggcatctacgtcttcacgctcctggaccattttgcagccggcacgtccatcctctttggagtgctcatcgaagccatcggagtggcctggttctatggtgttgggcagttcagcgacgacatccagcagatgaccgggcagcggcccagcctgtactggcggctgtgctggaagctggtcagcccctgctttctcctgttcgtggtcgtggtcagcattgtgaccttcagacccccccactacggagcctacatcttccccgactgggccaacgcgctgggctgggtcatcgccacatcctccatggccatggtgcccatctatgcggcctacaagttctgcagcctgcctgggtcctttcgagagaaactggcctacgccattgcacccgagaaggaccgtgagctggtggacagaggggaggtgcgccagttcacgctccgccactggctcaaggtgtagagggagcagagacgaagaccccaggaagtcatcctgcaatgggagagacacgaacaaaccaaggaaatctaagtttcgagagaaaggagggcaacttctactcttcaacctctactgaaaacacaaacaacaaagcagaagactcctctcttctgactgtttacacctttccgtgccgggagcgcacctcgccgtgtcttgtgttgctgtaataacgacgtagatctgtgcagcgaggtccaccccgttgttgtccctgcagggcagaaaaacgtctaacttcatgctgtctgtgtgaggctccctccctccctgctccctgctcccggctctgaggctgccccaggggcactgtgttctcaggcggggatcacgatccttgtagacgcacctgctgagaatccccgtgctcacagtagcttcctagaccatttactttgcccatattaaaaagccaagtgtcctgcttggtttagctgtgcagaaggtgaaatggaggaaaccacaaattcatgcaaagtcctttcccgatgcgtggctcccagcagaggccgtaaattgagcgttcagttgacacattgcacacacagtctgttcagaggcattggaggatgggggtcctggtatgtctcaccaggaaattctgtttatgttcttgcagcagagagaaataaaactccttgaaaccagctcaggctactgccactcaggcagcctgtgggtccttgcggtgtagggaacggcctgagaggagcgtgtcctatccccggacgcatgcagggcccccacaggagcgtgtcctatccccggacgcatgcagggcccccacaggagcatgtcctatccctggacgcatgcagggcccccacaggagcgtgtactaccccagaacgcatgcagggcccccacaggagcgtgtactaccccaggacgcatgcagggcccccactggagcgtgtactaccccaggacgcatgcagggcccccacaggagcgtgtcctatccccggaccggacgcatgcagggcccccacaggagcgtgtactaccccaggacgcatgcagggcccccacaggagcgtgtactaccccaggatgcatgcagggcccccacaggagcgtgtactaccccaggacgcatgcagggcccccatgcaggcagcctgcagaccacactctgcctggccttgagccgtgacctccaggaagggaccccactggaattttatttctctcaggtgcgtgccacatcaataacaacagtttttatgtttgcgaatggctttttaaaatcatatttacctgtgaatcaaaacaaattcaagaatgcagtatccgcgagcctgcttgctgatattgcagtttttgtttacaagaataattagcaatactgagtgaaggatgttggccaaaagctgctttccatggcacactgccctctgccactgacaggaaagtggatgccatagtttgaattcatgcctcaagtcggtgggcctgcctacgtgctgcccgagggcaggggccgtgcagggccagtcatggctgtcccctgcaagtggacgtgggctccagggactggagtgtaatgctcggtgggagccgtcagcctgtgaactgccaggcagctgcagttagcacagaggatggcttccccattgccttctggggagggacacagaggacggcttccccatcgccttctggccgctgcagtcagcacagagagcggcttccccattgccttctggggagggacacagaggacagcttccccatcgccttctggctgctgcagtcagcacagagagcggcttccccatcgccttctggggaggggctccgtgtagcaacccaggtgttgtccgtgtctgttgaccaatctctattcagcatcgtgtgggtccctaagcacaataaaagacatccacaatggaaaaa

SEQ ID NO: 29314 - DNA, 2770 bp, Homo sapiens
agaccaagagggaagaagcacagaattcctcaactcccagtgtgcccatgagtaagagcaaatgctccgtgggactcatgtcttccgtggtggccccggctaaggagcccaatgccgtgggcccgaaggaggtggagctcatccttgtcaaggagcagaacggagtgcagctcaccagctccaccctcaccaacccgcggcagagccccgtggaggcccaggatcgggagacctggggcaagaagatcgactttctcctgtccgtcattggctttgctgtggacctggccaacgtctggcggttcccctacctgtgctacaaaaatggtggcggtgccttcctggtcccctacctgctcttcatggtcattgctgggatgccacttttctacatggagctggccctcggccagttcaacagggaaggggccgctggtgtctggaagatctgccccatactgaaaggtgtgggcttcacggtcatcctcatctcactgtatgtcggcttcttctacaacgtcatcatcgcctgggcgctgcactatctcttctcctccttcaccacggagctcccctggatccactgcaacaactcctggaacagccccaactgctcggatgcccatcctggtgactccagtggagacagctcgggcctcaacgacacttttgggaccacacctgctgccgagtactttgaacgtggcgtgctgcacctccaccagagccatggcatcgacgacctggggcctccgcggtggcagctcacagcctgcctggtgctggtcatcgtgctgctctacttcagcctctggaagggcgtgaagacctcagggaaggtggtatggatcacagccaccatgccatacgtggtcctcactgccctgctcctgcgtggggtcaccctccctggagccatagacggcatcagagcatacctgagcgttgacttctaccggctctgcgaggcgtctgtttggattgacgcggccacccaggtgtgcttctccctgggcgtggggttcggggtgctgatcgccttctccagctacaacaagttcaccaacaactgctacagggacgcgattgtcaccacctccatcaactccctgacgagcttctcctccggcttcgtcgtcttctccttcctggggtacatggcacagaagcacagtgtgcccatcggggacgtggccaaggacgggccagggctgatcttcatcatctacccggaagccatcgccacgctccctctgtcctcagcctgggccgtggtcttcttcatcatgctgctcaccctgggtatcgacagcgccatgggtggtatggagtcagtgatcaccgggctcatcgatgagttccagctgctgcacagacaccgtgagctcttcacgctcttcatcgtcctggcgaccttcctcctgtccctgttctgcgtcaccaacggtggcatctacgtcttcacgctcctggaccattttgcagccggcacgtccatcctctttggagtgctcatcgaagccatcggagtggcctggttctatggtgttgggcagttcagcgacgacatccagcagatgaccgggcagcggcccagcctgtactggcggctgtgctggaagctggtcagcccctgctttctcctgttcgtggtcgtggtcagcattgtgaccttcagacccccccactacggagcctacatcttccccgactgggccaacgcgctgggctgggtcatcgccacatcctccatggccatggtgcccatctatgcggcctacaagttctgcagcctgcctgggtcctttcgagagaaactggcctacgccattgcacccgagaaggaccgtgagctggtggacagaggggaggtgcgccagttcacgctccgccactggctcaaggtgtagagggagcagagacgaagaccccaggaagtcatcctgcaatgggagagacacgaacaaaccaaggaaatctaagtttcgagagaaaggagggcaacttctactcttcaacctctactgaaaacacaaacaacaaagcagaagactcctctcttctgactgtttacacctttccgtgccgggagcgcacctcgccgtgtcttgtgttgctgtaataacgacgtagatctgtgcagcgaggtccaccccgttgttgtccctgcagggcagaaaaacgtctaacttcatgctgtctgtgtgaggctccctccctccctgctccctgctcccggctctgaggctgccccaggggcactgtgttctcaggcggggatcacgatccttgtagacgcacctgctgagaatccccgtgctcacagtagcttcctagaccatttactttgcccatattaaaaagccaagtgtcctgcttggtttagctgtgcagaaggtgaaatggaggaaaccacaaattcatgcaaagtcctttcccgatgcgtggctcccagcagaggccgtaaattgagcgttcagttgacacattgcacacacagtctgttcagaggcattggaggatgggggtcctggtatgtctcaccaggaaattctgtttatgttcttgcagcagagagaaataaaactccttgaaaccagctcaggctactgccactcaggcagcctgtgggtccttgcggtgtagggaacggcctgagaggagcgtgtcctatccccggacgcatgcagggcccccacaggagcgtgtcctatccccggacgcatgcagggcccccacaggagcgtgtactaccccaggacgcatgcag

SEQ ID NO: 29315 - DNA, 4502 bp, Homo sapiens
tcccttccccgcgaccctccgcccgccctcggaagaccgagacagcggagaggttgcgggtgagctgcgctgagcccaggagccgaggagtcgggagcgcagtagcgctgagcccgagcccgagcggccccgcgtcccgagcgcatcggagcggccgagccgcccggatgcagcgcctgtcccgggcagcgcagccccggccgcaggatctcacccagggtggcagaaggaggccttctggagctgacccacccccgacgaccatcagggtgaggcaactccaaggtcctactctctttctgtgcctgttacccaccccgtcctcctagggtgcccttgagccgcaaaactgctgtccacgtggaccgggggtgacatcgcacgtccatctgccaggacccctgcgtccaaattccgagacatggcgaccaacggcagcaaggtggccgacgggcagatctccaccgaggtcagcgaggcccctgtggccaatgacaagcccaaaaccttggtggtcaaggtgcagaagaaggcggcagacctccccgaccgggacacgtggaagggccgcttcgacttcctcatgtcctgtgtgggctatgccatcggcctgggcaacgtctggaggttcccctatctctgcgggaaaaatggtgggggagccttcctgatcccctatttcctgacactcatctttgcgggggtcccactcttcctgctggagtgctccctgggccagtacacctccatcggggggctaggggtatggaagctggctcctatgttcaagggcgtgggccttgcggctgctgtgctatcattctggctgaacatctactacatcgtcatcatctcctgggccatttactacctgtacaactccttcaccacgacactgccgtggaaacagtgcgacaacccctggaacacagaccgctgcttctccaactacagcatggtcaacactaccaacatgaccagcgctgtggtggagttctgggagcgcaacatgcatcagatgacggacgggctggataagccaggtcagatccgctggccactggccatcacgctggccatcgcctggatccttgtgtatttctgtatctggaagggtgttggctggactggaaaggtggtctacttttcagccacatacccctacatcatgctgatcatcctgttcttccgtggagtgacgctgcccggggccaaggagggcatcctcttctacatcacacccaacttccgcaagctgtctgactccgaggtgtggctggatgcggcaacccagatcttcttctcatacgggctgggcctggggtccctgatcgctctcgggagctacaactctttccacaacaatgtctacagggactccatcatcgtctgctgcatcaattcgtgcaccagcatgttcgcaggattcgtcatcttctccatcgtgggcttcatggcccatgtcaccaagaggtccattgctgatgtggcggcctcaggccccgggctggcgttcctggcatacccagaggcggtgacccagctgcctatctccccactctgggccatcctcttcttctccatgctgttgatgctgggcattgacagccagttctgcactgtggagggcttcatcacagccctggtggatgagtaccccaggctcctccgcaaccgcagagagctcttcattgctgctgtctgcatcatctcctacctgatcggtctctctaacatcactcaggggggtatttatgtcttcaaactctttgactactactctgccagtggcatgagcctgctgttcctcgtgttctttgaatgtgtctctatttcctggttttacggtgtcaaccgattctatgacaatatccaagagatggttggatccaggccctgcatctggtggaaactctgctggtctttcttcacaccaatcattgtggcgggcgtgttcattttcagtgctgtgcagatgacgccactcaccatgggaaactatgttttccccaagtggggccagggtgtgggctggctgatggctctgtcttccatggtcctcatccccgggtacatggcctacatgttcctcaccttaaagggctccctgaagcagcgcatccaagtcatggtccagcccagcgaagacatcgttcgcccagagaatggtcctgagcagccccaggcgggcagctccaccagcaaggaggcctacatctagggtgggggccactcaccgacccgacactctcaccccccgacctggctgagtgcgaccaccacttgatgtctgaggataccttccatctcaacctacctcgagtggcgagtccagacaccatcaccacgcagagaggggaggtgggaggacagttagacccctgggtgggccctgccgtgggcaaggatacccggtggcttctggcacctggcgggctggtgacctttttaatccaggccccatcagcatcccacgatcggccttggtaaccgccgcggtagatcatttttatcccgccagggagtgtgatgcaggaagaccacatgcgctcctggcttttaaacctgttcctgactgttctcttactgccgaaacccttgactgttatctcggactttgcaggagttcctttccctccgaacgctgctccatgcacaggaaaagggcattttgtacaatggggacttcccgggaacgcttgctcttaagtaccagaagccggcggagctctggctttcgtgtttttggttttctccttcccaaggcagctggattgaaaaaacaaaacaaaacaaaaaaacccaggggcgtcagtcgatattcccagggccgcttctcctgcagtctgtggagcgtccttgtccccgccgccggaatgaatgagcattctgcagcccgatgtccctgtcccctcctcgccgggccattctgattggacctggcccagtgcaatctgtccagacaagccctgcttgctggaaaactgccacaagcacaattgatctctttttatcgccattccaggggcctcaggtcctactggggaaacttcctataccggagctccagtttctcttaagctgcccaatttcacagagtacaaaatagttgtaggggaaatcaaggtgaaggatctgtccgacagtcaagacggatccacagtaatctttcggtctccttaaactaccaccctcgctgccacccaccccaagctgctgccgcctcaccttccttgaaatttctcagcgggagtctcctcactgccactaaaatccacccagcccactaactgaggagctagtgttaatccagagaaccccccgcaatgtgcttccgagattcagactgcttcattgggaagtatgatttgttcctttctggaattgggctccgtggtggcggcggcacttcaagcaaagacagtttcttgcaagctccagtagctccgcgtgtctcatttgccaggaagatgggttcccacgtagcaaatcgtacattgtgccctgtagctccttagctagttagctcacaagccgtgttttatgactaatccttaataactatggtaaataactgtgactgtggggtttttaatctcttgtcattctcatccaaaagtgaccagcataccagttcttgcaataagatattaccctcagaatattaagcacattattgtagagaaaaaaaaatatgtgtacacatatgaacgcacaacatgcacattcatcctcacatgtggcacgtaaggtctcatttgatattgtgtaggaaatctgaagccttttcctgaggtcatctgtaaaatagtctcattgccaaggcatccccagtgccagctggtgaatccatgatcaaaatgcatacgtattgttaaatgataaggtttagaatgacaggaacccatcactgtgtctcatggtcccacttccccatctgtgtgtgaattcctttagactaagggcaggaagacttccagctttctctttgttcttcaatgtgaaactgagaccaagtctctctaagacaaatgcagtgtatttaatgtttgtaagcaattctaagtgagatgtttggcaagaaatcccctaactgatttccatccaaacctaccttatagagcacaatattaagtgttgtacaattactgtgagaactgtgaatatgtgtaacttttttttagtatttgcccggggggaaaaagatattgtattatcatatatgcttttttgcaataaggatttattctcagaacaccaagtaaatctatctctatataaaaaatatatgtaatatatacatattcaaagtatatacagagcctgttttaaaaaatacagtattatttagtaaaattatctgttctatggaccaaatgtaaaatatttataaatgaagatgcattttaaatgtctataaatggtgtcataactagagcacgggcgttatgtaagtttctaagaatttagaggataaataataaaggttctatgatatacaa

SEQ ID NO: 29316 - DNA, 472 bp, Homo sapiens
ttccccgcgaccctccgcccgccctcggaagaccgagacagcggagaggttgcgggtgagctgcgctgagcccaggagccgaggagtcgggagcgcagtagcgctgagcccgagcccgagcggccccgcgtcccgagcgcatcggagcggccgagccgcccggatgcagcgcctgtcccgggcagcgcagccccggccgcaggatctcacccagggtggcagaaggaggccttctggagctgacccacccccgacgaccatcagggtgcccttgagccgcaaaactgctgtccacgtggaccgggggtgacatcgcacgtccatctgccaggacccctgcgtccaaattccgagacatggcgaccaacggcagcaaggtggccgacgggcagatctccaccgaggtcagcgaggcccctgtggccaatgacaagcccaaaaccttggtggtcaaggtgcagaagaaggcggc

SEQ ID NO: 29317 - DNA, 1756 bp, Homo sapiens
ctagggtgcccttgagccgcaaaactgctgtccacgtggaccgggggtgacatcgcacgtccatctgccaggacccctgcgtccaaattccgagacatggcgaccaacggcagcaaggtggccgacgggcagatctccaccgaggcgtgggccttgcggctgctgtgctatcattctggctgaacatctactacatcgtcatcatctcctgggccatttactacctgtacaactccttcaccacgacactgccgtggaaacagtgcgacaacccctggaacacagaccgctgcttctccaactacagcatggtcaacactaccaacatgaccagcgctgtggtggagttctgggagcgcaacatgcatcagatgacggacgggctggataagccaggtcagatccgctggccactggccatcacgctggccatcgcctggatccttgtgtatttctgtatctggaagggtgttggctggactggaaaggtggtctacttttcagccacatacccctacatcatgctgatcatcctgttcttccgtggagtgacgctgcccggggccaaggagggcatcctcttctacatcacacccaacttccgcaagctgtctgactccgaggtgtggctggatgcggcaacccagatcttcttctcatacgggctgggcctggggtccctgatcgctctcgggagctacaactctttccacaacaatgtctacagggactccatcatcgtctgctgcatcaattcgtgcaccagcatgttcgcaggattcgtcatcttctccatcgtgggcttcatggcccatgtcaccaagaggtccattgctgatgtggcggcctcaggccccgggctggcgttcctggcatacccagaggcggtgacccagctgcctatctccccactctgggccatcctcttcttctccatgctgttgatgctgggcattgacagccagttctgcactgtggagggcttcatcacagccctggtggatgagtaccccaggctcctccgcaaccgcagagagctcttcattgctgctgtctgcatcatctcctacctgatcggtctctctaacatcactcaggggggtatttatgtcttcaaactctttgactactactctgccagtggcatgagcctgctgttcctcgtgttctttgaatgtgtctctatttcctggttttacggtgtcaaccgattctatgacaatatccaagagatggttggatccaggccctgcatctggtggaaactctgctggtctttcttcacaccaatcattgtggcgggcgtgttcattttcagtgctgtgcagatgacgccactcaccatgggaaactatgttttccccaagtggggccagggtgtgggctggctgatggctctgtcttccatggtcctcatccccgggtacatggcctacatgttcctcaccttaaagggctccctgaagcagcgcatccaagtcatggtccagcccagcgaagacatcgttcgcccagagaatggtcctgagcagccccaggcgggcagctccaccagcaaggaggcctacatctagggtgggggccactcaccgacccgacactctcaccccccgacctggctgagtgcgaccaccacttgatgtctgaggataccttccatctcaacctacctcgagtggcgagtccagacaccatcaccacgcagagaggggaggtgggaggacagttagacccctgggtgggccctgccgtgggc

SEQ ID NO: 29318 - DNA, 4296 bp, Homo sapiens
gaaaagccagctcgcccggggcggcggcgcagagccgggccggcgcacgaggcagccagcgcggccatgacggcggagaaggcgctgcccctgggcaatgggaaggctgctgaggaggcgcgggagtccgaggcgccgggtggcggctgcagcagcgggggcgcggcgcccgcgcgccacccgcgcgtcaagcgcgacaaggcggtccacgagcgcggccactggaacaacaaggtggagttcgtgctgagcgtggccggggagatcattgggctgggcaacgtgtggcgcttcccctacctgtgctacaagaacggaggaggggcattcctgattccctacgtggtgttttttatttgctgtggaattcctgtttttttcctggagacagctctggggcagttcacaagtgaaggtggcattacgtgttggaggaaagtttgccctttatttgaaggcattggctatgcaacacaggtgattgaggcccatctgaatgtgtactacatcatcatcctggcatgggccattttttacctgagcaactgcttcactactgagctaccctgggctacctgtgggcatgagtggaacacagagaattgtgtggagttccagaaactgaatgtgagcaactacagccatgtgtctctgcagaatgccacctcccctgtcatggagttttgggagcaccgggtcctggccatctctgacgggatcgagcacatcgggaaccttcgctgggagctggccttgtgtctcttggcagcctggaccatctgttacttctgtatctggaaggggaccaagtctacaggaaaggttgtatacgtgactgcgacattcccctacatcatgctgctgatcctcctgatacgaggggtcacgttgcccggggcctcagagggcatcaagttctacttgtaccctgacctctcccggctctccgacccccaggtctgggtagatgctggaacgcagatctttttctcctatgccatttgcctgggctgtctgaccgctctgggaagttataacaattataacaacaactgctacagggactgcatcatgctctgttgcctgaacagcggcaccagcttcgtggctgggtttgccatcttctcagtcctgggttttatggcgtacgagcagggggtacccattgctgaggtggcagagtcaggccccggcctggcctttattgcgtaccccaaggcggtcaccatgatgcctctctccccgctgtgggccaccttgttcttcatgatgctcatcttcctgggcctggacagccagtttgtgtgtgtggaaagcctggtgaccgccgtggtggacatgtaccccaaggttttccggaggggttaccggcgggagctgctcatcctagccttgtctgttatctcctattttctgggcctcgtgatgttaacagagggtggcatgtacatcttccagctctttgactcctatgccgccagtgggatgtgccttctcttcgtggccatctttgagtgcatctgcatcggctgggtgtatggaagcaaccggttctatgataacattgaagacatgattggctaccggccaccgtcgctcattaagtggtgctggatgatcatgacccctgggatctgcgcggggatcttcatcttcttcttgatcaagtacaagccactcaagtacaacaacatctacacctacccagcctggggctatggcattggctggctcatggccctgtcctccatgctctgcatcccgctctggatctgcatcacagtgtggaagacggaggggacactgcccgagaaactccagaagttgacgacccccagcacagatctgaaaatgcggggcaagcttggggtgagcccacggatggtgacagttaatgactgtgatgccaaactcaagagtgacgggaccatcgcagccatcacagagaaggagacgcacttctgagcggccaccagccatctggggctcttcttcctttcttccccccgtgtatgtaaatgaattcctgaaccccatacttcacctaatggtaggggcttgcttgttttgcacaggattaattaacaagttaattttaaggtggccactgtacactgctctaaagtcatatcccctccccgcccccagtcatcatggaagtaaccactacaaagagataacactgtacggggactgccagatcttctgtcctagggcagttttaatcaatgttttctagggattaggaagaagtgtataatattgtaaaactttttttactggggttgtgggccaggtggggtggggagtgatggctgtcctcctctgtcggccttttaatgaccgttctgtgtcccatgtatgtctctgaccatccacagccgcccctcctccataccccagggataatttttccttcaaaccttccctttccaagggacactgggtttgcagacagcaaggctatgtggcagagaagaaaaagtccagcagactcaggactcctgggctgcaggcccccctctgccctgatcccatgaagtgaccttgggcactccctttccctccctgggcctcagtttccccatctcccaaatgggaggaggagccggattgggttatttcttagggattctctttgtgtgccttgctggcttccagacctgccgtggaccttggcttcctctgaagacttgcaggcaataatctccgccctcccagttgtacctcctccccacctgcttatttaaaatcaagtttattgtagaaatggtgtggtgttgatgtgtgttttccctaaaactctaatttcatctcatctgtgggcagccctgctctctggacaccagtgggtcctcagcccccatggcaggggctcctctgtctggcctgcctttttttcctggtcagctgctcttagcgccggctctgcctctccacccttggcagggctggctggagttgctgtggggactgattttctgggtggggaagcagccatctattcttgcagccatctcagccagggtctatgtcttaggaccttcctccggccttccatgagaagcagccacagggggcctggtttcctcctaaggcccttctctgtcccaggccacctcttctccctcctcctgtcccctaacctccacctaccaccatcctccctctcagttctctcccatccttgcccctggttcaggagccattctacctgcctcagtggccaggcgcaaggctacaggtgcagtcacctgttcccggccaccttccctcccatctttggcagacagaagtctcagctctcactagagggaagacctgggcatcctgctggctcctctctccgtggggcctggagtctggtgctgttccccagccagcctggctgcagacctctctggctgataccgctcttcttctttaattggacttcatatcaagcctctgccttggtttctgagctatatgagggtggggaaggcacactcttttttcctttttccttaggttcccaatattatttggtggaaacgtgggctttctccaaaccaaggcctgagtttcctgtaagggtcctctgtttttgattcacccaaaagtctgcaaacccccagcatctctgctctggccagccctgatctgaagcctgtgtctactaagagggatgcccagtgccccactgggcaggacgggaagcctagcctgggccccctctgtgcacacagttcaggcctgcccagcttcttatgggcaagccaccatcccactctcgtctccctgagctgtctggttctgcggacccaggaagggccaggctggggccctgcttgtgtttatcctcggctgctgtcttcccagcaggccccaggcaaggaggcttcccattgctgctgctaccggttctccacagatccctgtggtccgccatcgccgacacacacacacgtcgtaatgtggctaacgcttgactcacttaacactactcatggggcagggcggagggtggattgttgctttttgttttttgtaatttcctactagtatttgggtaactttgggggtggggagggcaatgtgggggcaggggaacatgtcattgtgatgacttttttgatattcattagaaacaatacatcctttctgagatatttacagtattattaaaaaatgaaaaaggttgtactgttttgcataatgaacatttttattgggcattcaaagggtgcaagattgtctgcttactcatttttaaaaattaaagaaatgaacaatcagtgtggctattcctagcaa

SEQ ID NO: 29319 - DNA, 2794 bp, Homo sapiens
aaaagccagctcgcccggggcggcggcgcagagccgggccggcgcacgaggcagccagcgcggccatgacggcggagaaggcgctgcccctgggcaatgggaaggctgctgaggaggcgcgggagtccgaggcgccgggtggcggctgcagcagcgggggcgcggcgcccgcgcgccacccgcgcgtcaagcgcgacaaggcggtccacgagcgcggccactggaacaacaaggtggagttcgtgctgagcgtggccggggagatcattgggctgggcaacgtgtggcgcttcccctacctgtgctacaagaacggaggaggggcattcctgattccctacgtggtgttttttatttgctgtggaattcctgtttttttcctggagacagctctggggcagttcacaagtgaaggtggcattacgtgttggaggaaagtttgccctttatttgaaggcattggctatgcaacacaggtgattgaggcccatctgaatgtgtactacatcatcatcctggcatgggccattttttacctgagcaactgcttcactactgagctaccctgggctacctgtgggcatgagtggaacacagagaattgtgtggagttccagaaactgaatgtgagcaactacagccatgtgtctctgcagaatgccacctcccctgtcatggagttttgggagtaagtggagaagaacttgtctcccttggcctgtgggggctctgtcctggttctgctcagttggtcttgcccctattcctggaaaaagcctgatccttcttgcagcctggcacttcctggcttctgtgagcattcgacagcttcggaagcaagagtgcagatcttcagaggtttcccaaaggggcagctgagagaaatgttttcttgttctttgataacatgtcagcatgcatagtgggttattagggcaggaagtacttggtgaaaggatagacagtttaaaaattcattttgagcaaaagaggagatgcagcctgtttgcaataagctaagtcaagagtgtatttagcctggaaagcataagtctctagaggggataggttagctttctttcagtagctgaagtgtcatatggaaaagaaggagatcaaatttaatggatagagattataaagaggcaggtttcaaatgtgcgtagggaagaacttggtctcatagcatagcattatctggaagcacttcagaaggttgtgagcacccatccctggaagttgaccagtatagggttgccaatcattgttgggggtgtgtctgaatccactgaaattataagtagtacttgtgtggttgggcattttcccagaaattggcatagttttatcagagttccaaaggatctgtgacccttacagggctgctatgtgtggttgtgtacattgcacactgaacaacccaaggggccataatttacattatgaaatatacattccagaattgtgtggtgcacgacctgtataaccatacacagtggccctgacttgcaagtttgttttaaaggtagaaggatcccttgccccaggtattggaaagaagtttcctgtatgggtcaaaggctggactaaatgctttctgaagcttttcaatctaaaaagtcctggcttcattgaagaagcctcccttactctgatggtgattaatagtagtatatgtgtgtgtggtggggcagtggtttatgagtgatttttatttttttcccagataccattcgtctcctgccttctctagaggtcattatgctgaatttagatttaccactctcatataaatcttcatacttttcatatatatatgccccaaatagcacctaggtctttcttgcatatttttcaaatttgtgatactggcatccattatttacattttttataacaactttatttctttgctcaatattggttcttagatgtatccatattggtacatgtagctttggttctttcatttttctatcagagtatttcattgtatgaatggcctgtgttgtatttatccaggtcctcttggtcctcttgatgggcatttaggctgttgcccatttctcactattattaagcacactgagtgaatgtctagtctgtgcttccttgagtggaattgctgggttgtagcatacatgcgttgtcagttttatcatataacgtaaaattactttagaaagaaattaatctaggccaggcatggtggctcacacctgtaattccagcactttgggaagccgaggtgggcggatcacctgaggtcaggagtttgagaccagcctggccaacatggtgaaaccctgtctttactaaaaatacaaaaattagctgggtagtggttcatgcctgcaatctcatctactcaggaggttgaagcaggagaatcacttgaacctggaaggcgaaagttgcagtgagccgagatcggcgccactgcactccagcctgggtgacagagcgagactgtctcaaaaaaaaaaaaaaaaattaatttacactccaaacaagagtttgtgagaatttctgcagcttcacattttggacagcacttggtctgttcagtttttgttttgccagtgtaatgggcattaaatgataacttactattttaaattcacatttctctaattacttgtgaggttaagcaccttttcatgttttgttttgtctgttttttgctatttgatttctgtacctgtgaacttcaggtttacattcgtttctatttggatagtttgtcttttcttacagatagaaattgttaatacattctagatattatcttttc

SEQ ID NO: 29320 - DNA, 7084 bp, Homo sapiens
cacgccaaacacgcagccccctcccgctggagtgacaactggccagcatactctaggctgttgtccctttaaaacttgaatccaagggggtaatgatttatcaaacttgtattatcaagaaaatgtcaaaccaagggcaccttgctttgcactgacgcaaacccggcctttcccaaggagatatagaaagcgcctctcctgcctgagccaaacccagtcttgtcaatagcgggtttcaccctccaccagttcagtctgttgcctgtgtcagacatggattgcagtgctcccaaggaaatgaataaactgccagccaacagcccggaggcggcggcggcgcagggccacccggatggcccatgcgctcccaggacgagcccggagcaggagcttcccgcggctgccgccccgccgccgccacgtgtgcccaggtccgcttccaccggcgcccaaactttccagtcagcggacgcgcgagcctgcgaggctgagcggccaggagtggggtcttgcaaactcagtagcccgcgggcgcaggcggcctctgcagctctgcgggacttgagagaggcgcaaggcgcgcaggcctcgccccctcccgggagctccgggcccggcaacgcgctgcactgtaagatcccttttctgcgaggcccggagggggatgcgaacgtgagtgtgggcaagggcaccctggagcggaacaatacccctgttgtgggctgggtgaacatgagccagagcaccgtggtgctggccacggatggaatcacgtccgtgctcccgggcagcgtggccaccgttgccacccaggaggacgagcaaggggatgagaataaggcccgagggaactggtccagcaaactggacttcatcctgtccatggtggggtacgcagtggggctgggcaatgtctggaggtttccctacctggccttccagaacgggggaggtgctttcctcatcccttacctgatgatgctggctctggctggattacccatcttcttcttggaggtgtcgctgggccagtttgccagccagggaccagtgtctgtgtggaaggccatcccagctctacaaggctgtggcatcgcgatgctgatcatctctgtcctaatagccatatactacaatgtgattatttgctatacacttttctacctgtttgcctcctttgtgtctgtactaccctggggctcctgcaacaacccttggaatacgccagaatgcaaagataaaaccaaacttttattagattcctgtgttatcagtgaccatcccaaaatacagatcaagaactcgactttctgcatgaccgcttatcccaacgtgacaatggttaatttcaccagccaggccaataagacatttgtcagtggaagtgaagagtacttcaagtactttgtgctgaagatttctgcagggattgaatatcctggcgagatcaggtggccactagctctctgcctcttcctggcttgggtcattgtgtatgcatcattggctaaaggaatcaagacttcaggaaaagtggtgtacttcacggccacgttcccgtatgtcgtactcgtgatcctcctcatccgaggagtcaccctgcctggagctggagctgggatctggtacttcatcacacccaagtgggagaaactcacggatgccacggtgtggaaagatgctgccactcagattttcttctctttatctgctgcatggggaggcctgatcactctctcttcttacaacaaattccacaacaactgctacagggacactctaattgtcacctgcaccaacagtgccacaagcatctttgccggcttcgtcatcttctccgttatcggcttcatggccaatgaacgcaaagtcaacattgagaatgtggcagaccaagggccaggcattgcatttgtggtttacccggaagccttaaccaggctgcctctctctccgttctgggccatcatctttttcctgatgctcctcactcttggacttgacactatgtttgccaccatcgagaccatagtgacctccatctcagacgagtttcccaagtacctacgcacacacaagccagtgtttactctgggctgctgcatttgtttcttcatcatgggttttccaatgatcactcagggtggaatttacatgtttcagcttgtggacacctatgctgcctcctatgcccttgtcatcattgccatttttgagctcgtggggatctcttatgtgtatggcttgcaaagattctgtgaagatatagagatgatgattggattccagcctaacatcttctggaaagtctgctgggcatttgtaaccccaaccattttaacctttatcctttgcttcagcttttaccagtgggagcccatgacctatggctcttaccgctatcctaactggtccatggtgctcggatggctaatgctcgcctgttccgtcatctggatcccaattatgtttgtgataaaaatgcatctggcccctggaagatttattgagaggctgaagttggtgtgctcgccacagccggactggggcccattcttagctcaacaccgcggggagcgttacaagaacatgatcgaccccttgggaacctcttccttgggactcaaactgccagtgaaggatttggaactgggcactcagtgctagtccagtggtgtgggatggtccagacttgatcctgtttttcctctctgcctcctcctaatgttttccatagctctcctcccatttttcttcatctttcttcctacatcttggttcacatccacgcatgagagtgattatgtagaaaagtaggcatagtgtcgcatgctgcagtaaagagctacatagaccacctgaagcgctgtttgcctgtgcccatggtgactgtttctggtcaggttggtcccctgaccacacgttttaccctgcagaggaggatcagttaggtgagcactggtaggtatgcgtggttttgtcaatagagaggtatccactgtgtgatggcatggggggtgccagtaaggcatgtatagagtggccgaattacaagactttatttggacttgaacagaactgagcaatgtggtgatcttgttcagacacacaaagttcaagacaggtttttttttttttcagagagttagcagtggtcagaaaatgttttggatgtaagacaagaccattcaatttggacaccactgaggtggttaagtttatatttccagtcaccactggggatctgtttccttcgtttggatcagcaatctccagttaccactaactcagatgctacagtctacacattgtgactttgattgaactgtcagttttcttccctcaactgtctttttttgttttaaataaccacatttgtgagttcttttggtcatttcctccacctctgcccaagaagccatcatataagttgtgcctcattttgtacgttcatagtagagctccatgctcatttctacatgatatttagcaccatggttcaatgtcacgatcctgtgtttcttctctaaatgtctttctataagctgtagacaccttgtcttttgacctctgggaaaacaagacttaccctggttctgtctatatattatatatataggacacatgctcttaaaagacagataacttcttaatttttactctttttcattcacagtaaatgccaactgtggtcatagagaaatcaaagaaatggagagtttaatagaaagcaaccacaatattcactgcactggtagtacattttaggacatggtatttatagaactttctgataaatacagcttaggtaagtagcgagtgagccaattaagactatagcttttaagactacatttagccaattcaattttaagagttccctattcacagtactcattttaacggcactctaatgagagctgatcatatgtctgcagaaattggcaaagtgtaaactttattatcttcttgtatcctgaacatgcatatatgaaatttttaaaatgtgacatgtgttcatgtagtgtgtacttgtagtggtgttttctgtccttataaatatcttttgaattctgtagagatggtgagtttagtatagtgtagtctggggattttattttcccttacagtaataatatctaaacctaaaattgtttcctttaggggagatcatttcaatcattttcttcatttatcttcatagtacagggtctcaggcaaagtttttcagttcaaatcttgtatattgttgtgacattttcatcctgtttaacagcaatgaaacccaacaacaggctttaatgtacatttttttttaaaagatttcatttgttaaaaaaagtctcaactcattttactgagctctcccttttctagggcaagtatcatcgccatttgccaacatcaatatgaacttccagtttttaagagtagcttgtgaaaggttttagaaaaggaaacaaagatgggttttgaactttagattttcatgtcttttgtctgcagtgtatatttgttctcccctctccttctcctcctttccccccttgtctcccaaagctcaaacttgcttgagtctatcatagagactaaaccttgagcttcccctaaacttagctttaggaagctgagctgtggcctcacctgtctgccatgaacacagatttctctaagaaagccatattgatgagaagcccccaattactgcagcagacgtcgcacaatggtaccaaaaatgagcctctccagctgatacctggtagagtgagaggagccaggaggaataacttaggcctggaaattatctgcaggctttgcaatttgaaggttgagaaagagagcttaaatcaattagcattctctcatgggactggtatgtttgtgtcaggatgaatggtttttggctctcctgttgcctcttggctaaaactctgattgagccaatggttgcagtctgatgctggacgccaacccaatttctgctaattattgcttttgtgattaaaagaaggtgggggtggggggctcccacagatgctgccaggtttgttttgtacaaactgaaagttaacttaattgtgagaacggagacctcatcactagctgcatgttttggatttgggggcatttacatttgtgttaattatgatttgtccaggtaagatgcagtagctgctccctgagcagctgtttcccccccaccccacttcactataatttccaagatttatttccctttgtttaaagggacacgcttaggtgaaaggttccaaatttacctggaaatggttaccttgtaaatttagcttgtctaatggattgtttccatgatattaaaatgtacagtcaattggaagaaaaaaaatgaaaaaaataaaatgaataacattgttagaaactggcacctgaaaacttcccttcaaagtgggggaaaaaaccgagtagctgaggaaagactttcattggttcactgtgtagaatggtggagcattttccacttgtgagattatttcataacaccaacaaatgccagaaactcattcagaaaaaaagccatatgtgaaaaacagtaatcctgtcatatccttagaggagaaaaaatgtatatttcttaacaagtggtgttgtgacttcttatgcaaatgtcttgcatattagtaacttttattatctttaggactgtgcttatcaggtacaaatgtgtctagttctgttttattgtttctttttcctttatatttatgtattgcatgaggtctgtggtcaatgcaaaatcatgatgacctcaatgtctttgaaatttgcaatgtgtttttaatatgtaagaaatgtaatcaacttgtatttcagtaagcagcactttaaaaagagtttaacatgatgacctttaaatggataggacttgggttgtttttatggtaatgttgcattggagttgagttttcctttaattaagttcttgtttcctcatctatgtgtctctcagtgcttcctgtccacctttgctctcagcatggtttcccatgcctaaaagtaagattttcttttctctttgttcccttggctgtaggtcattgtcctcttcccagaggctagcacaataactgttgctcaatgtaagatgagatggcaagatcatactactgttgttgcacctggatttgagttgggacatgcttctttgaggcagatgattcaagagaggacgtgctgtgtggcaggtgttttgcaggaccaaaaggccaaggccaacagaggagcatttccttctctttcacactgggtatcaagcagaaaacttccaggctgggagcaaaggtgtgggtgattctgccttgatactcatttccccacaaagtggccctaggatttgtgaaagtgaagcttcctatctttcccagattttgctttaattgcccagaaaggccaagtagttttgaaatgtggtctttgctcaggtcacctctgagcagcctgcagccaaagagaaagtgttttcagattaggtattcatcacctctgaaaagcaagcagtggtttgacttgcctgccacggattaaatacatcttcaggtaaccatttgccttacaggtgtattttactgttaggatgattcttagtaattgactaaaaactgttttgtctctcatttgtttgtggtttttgcactttattatggacctgtaaaggaataggttaattcttacattgtgtacttggctaatgtcctaaatgcaggcatcttttgtgggtactgttgcccatgaataaacatatgttccctaatcaggtccttatatttttccattaactatacatgaagaaaatatattatgttacaaatgatgcatcatatatatatatatatatatatatatatcttatagattacatattatatactgcacattattcatttaagaagtcattcttgaggccctacctcaaattttctatttatgtataaaaatgcaatttattgtattatatatttgcctattatgtactgatataaattagaatttaccctaataatgtatgagttcacaaaaccctaaataaatgtcagtgtttaaaacatga

SEQ ID NO: 29321 - DNA, 2168 bp, Homo sapiens
cccacacaccccactccagctccggagcacccgtgctgggctgcatggggactggccggaggggcagggccaggggagcgggtaggcagagcttcgggaggagatgaggtgaaagtaattgacgctgcccagcccggcagtgggagaggcaggggatgcgtcagtgtcgcgctggagctggcagaggtgtgaatgagcggcggagacacgcgggctgcgatcgctcgccccaggatggccgcggctcatggacctgtggccccctcttccccagaacagaatggtgctgtgcccagcgaggccaccaagagggaccagaacctcaaacggggcaactggggcaaccagatcgagtttgtactgacgagcgtgggctatgccgtgggcctgggcaatgtctggcgcttcccatacctctgctatcgcaacgggggaggcgccttcatgttcccctacttcatcatgctcatcttctgcgggatccccctcttcttcatggagctctccttcggccagtttgcaagccaggggtgcctgggggtctggaggatcagccccatgttcaaaggagtgggctatggtatgatggtggtgtccacctacatcggcatctactacaatgtggtcatctgcatcgccttctactacttcttctcgtccatgacgcacgtgctgccctgggcctactgcaataacccctggaacacgcatgactgcgccggtgtactggacgcctccaacctcaccaatggctctcggccagccgccttgcccagcaacctctcccacctgctcaaccacagcctccagaggaccagccccagcgaggagtactggaggctgtacgtgctgaagctgtcagatgacattgggaactttggggaggtgcggctgcccctccttggctgcctcggtgtctcctggttggtcgtcttcctctgcctcatccgaggggtcaagtcttcagggaaagtggtgtacttcacggccacgttcccctacgtggtgctgaccattctgtttgtccgcggagtgaccctggagggagcctttgacggcatcatgtactacctaaccccgcagtgggacaagatcctggaggccaaggtgtggggtgatgctgcctcccagatcttctactcactgggctgcgcgtggggaggcctcatcaccatggcttcctacaacaagttccacaataactgttaccgggacagtgtcatcatcagcatcaccaactgtgccaccagcgtctatgctggcttcgtcatcttctccatcctcggcttcatggccaatcacctgggcgtggatgtgtcccgtgtggcagaccacggccctggcctggccttcgtggcttaccccgaggccctcacactacttcccatctccccgctgtggtctctgctcttcttcttcatgcttatcctgctggggctgggcactcagttctgcctcctggagacgctggtcacagccattgtggatgaggtggggaatgagtggatcctgcagaaaaagacctatgtgaccttgggcgtggctgtggctggcttcctgctgggcatccccctcaccagccaggcaggcatctattggctgctgctgatggacaactatgcggccagcttctccttggtggtcatctcctgcatcatgtgtgtggccatcatgtacatctacgggcaccggaactacttccaggacatccagatgatgctgggattcccaccacccctcttctttcagatctgctggcgcttcgtctctcccgccatcatcttctttattctagttttcactgtgatccagtaccagccgatcacctacaaccactaccagtacccaggctgggccgtggccattggcttcctcatggctctgtcctccgtcctctgcatccccctctacgccatgttccggctctgccgcacagacggggacaccctcctccagcgtttgaaaaatgccacaaagccaagcagagactggggccctgccctcctggagcaccggacagggcgctacgcccccaccatagccccctctcctgaggacggcttcgaggtccagccactgcacccggacaaggcgcagatccccattgtgggcagtaatggctccagccgcctccaggactcccggatatgagcacagctgccagggga

SEQ ID NO: 29322 - DNA, 2330 bp, Homo sapiens
cccacacaccccactccagctccggagcacccgtgctgggctgcatggggactggccggaggggcagggccaggggagcgggtaggcagagcttcgggaggagatgaggtgaaagtaattgacgctgcccagcccggcagtgggagaggcaggggatgcgtcagtgtcgcgctggagctggcagaggtgtgaatgagcggcggagacacgcgggctgcgatcgctcgccccaggatggccgcggctcatggacctgtggccccctcttccccagaacaggtgacgcttctccctgttcagagatccttcttcctgccacccttttctggagccactccctctacttccctagcagagtctgtcctcaaagtctggcatggggcctacaactctggtctccttccccaactcatggcccagcactccctagccatggcccagaatggtgctgtgcccagcgaggccaccaagagggaccagaacctcaaacggggcaactggggcaaccagatcgagtttgtactgacgagcgtgggctatgccgtgggcctgggcaatgtctggcgcttcccatacctctgctatcgcaacgggggaggcgccttcatgttcccctacttcatcatgctcatcttctgcgggatccccctcttcttcatggagctctccttcggccagtttgcaagccaggggtgcctgggggtctggaggatcagccccatgttcaaaggagtgggctatggtatgatggtggtgtccacctacatcggcatctactacaatgtggtcatctgcatcgccttctactacttcttctcgtccatgacgcacgtgctgccctgggcctactgcaataacccctggaacacgcatgactgcgccggtgtactggacgcctccaacctcaccaatggctctcggccagccgccttgcccagcaacctctcccacctgctcaaccacagcctccagaggaccagccccagcgaggagtactggaggctgtacgtgctgaagctgtcagatgacattgggaactttggggaggtgcggctgcccctccttggctgcctcggtgtctcctggttggtcgtcttcctctgcctcatccgaggggtcaagtcttcagggaaagtggtgtacttcacggccacgttcccctacgtggtgctgaccattctgtttgtccgcggagtgaccctggagggagcctttgacggcatcatgtactacctaaccccgcagtgggacaagatcctggaggccaaggtgtggggtgatgctgcctcccagatcttctactcactgggctgcgcgtggggaggcctcatcaccatggcttcctacaacaagttccacaataactgttaccgggacagtgtcatcatcagcatcaccaactgtgccaccagcgtctatgctggcttcgtcatcttctccatcctcggcttcatggccaatcacctgggcgtggatgtgtcccgtgtggcagaccacggccctggcctggccttcgtggcttaccccgaggccctcacactacttcccatctccccgctgtggtctctgctcttcttcttcatgcttatcctgctggggctgggcactcagttctgcctcctggagacgctggtcacagccattgtggatgaggtggggaatgagtggatcctgcagaaaaagacctatgtgaccttgggcgtggctgtggctggcttcctgctgggcatccccctcaccagccaggcaggcatctattggctgctgctgatggacaactatgcggccagcttctccttggtggtcatctcctgcatcatgtgtgtggccatcatgtacatctacgggcaccggaactacttccaggacatccagatgatgctgggattcccaccacccctcttctttcagatctgctggcgcttcgtctctcccgccatcatcttctttattctagttttcactgtgatccagtaccagccgatcacctacaaccactaccagtacccaggctgggccgtggccattggcttcctcatggctctgtcctccgtcctctgcatccccctctacgccatgttccggctctgccgcacagacggggacaccctcctccagcgtttgaaaaatgccacaaagccaagcagagactggggccctgccctcctggagcaccggacagggcgctacgcccccaccatagccccctctcctgaggacggcttcgaggtccagccactgcacccggacaaggcgcagatccccattgtgggcagtaatggctccagccgcctccaggactcccggatatgagcacagctgccagggga

SEQ ID NO: 29323 - DNA, 2162 bp, Homo sapiens
ttttccagggtccagggcaagtgcccgcatgggctgggagccggtgtgtcctcatccctggacgccggggacgggtggagatgtcagcggatggcagcgagggtgaggagactcgaaagctacacttctcccctgtaggacatcctgacttgaccttcaaaagaatggtgctgtgcccagcgaggccaccaagagggaccagaacctcaaacggggcaactggggcaaccagatcgagtttgtactgacgagcgtgggctatgccgtgggcctgggcaatgtctggcgcttcccatacctctgctatcgcaacgggggaggcgccttcatgttcccctacttcatcatgctcatcttctgcgggatccccctcttcttcatggagctctccttcggccagtttgcaagccaggggtgcctgggggtctggaggatcagccccatgttcaaaggagtgggctatggtatgatggtggtgtccacctacatcggcatctactacaatgtggtcatctgcatcgccttctactacttcttctcgtccatgacgcacgtgctgccctgggcctactgcaataacccctggaacacgcatgactgcgccggtgtactggacgcctccaacctcaccaatggctctcggccagccgccttgcccagcaacctctcccacctgctcaaccacagcctccagaggaccagccccagcgaggagtactggaggctgtacgtgctgaagctgtcagatgacattgggaactttggggaggtgcggctgcccctccttggctgcctcggtgtctcctggttggtcgtcttcctctgcctcatccgaggggtcaagtcttcagggaaagtggtgtacttcacggccacgttcccctacgtggtgctgaccattctgtttgtccgcggagtgaccctggagggagcctttgacggcatcatgtactacctaaccccgcagtgggacaagatcctggaggccaaggtgtggggtgatgctgcctcccagatcttctactcactgggctgcgcgtggggaggcctcatcaccatggcttcctacaacaagttccacaataactgttaccgggacagtgtcatcatcagcatcaccaactgtgccaccagcgtctatgctggcttcgtcatcttctccatcctcggcttcatggccaatcacctgggcgtggatgtgtcccgtgtggcagaccacggccctggcctggccttcgtggcttaccccgaggccctcacactacttcccatctccccgctgtggtctctgctcttcttcttcatgcttatcctgctggggctgggcactcagttctgcctcctggagacgctggtcacagccattgtggatgaggtggggaatgagtggatcctgcagaaaaagacctatgtgaccttgggcgtggctgtggctggcttcctgctgggcatccccctcaccagccaggcaggcatctattggctgctgctgatggacaactatgcggccagcttctccttggtggtcatctcctgcatcatgtgtgtggccatcatgtacatctacgggcaccggaactacttccaggacatccagatgatgctgggattcccaccacccctcttctttcagatctgctggcgcttcgtctctcccgccatcatcttcctccaggctcaggtccaccgccgcctcccccagaatcctcttcacttcgcgtcgctcccggagcggaacgtgctcctccaccagctcccacagcgagggggagtgccggagcatgacccaccgacgccgccgtccccggctcggacctacgggccgcaggtcagagtgcgggaggtaccgcgggcccgccggcaacgctcaccaaaccccgcccctctatgggccccgccctctcccaagccccacccgtgctctgccgctggtcccctcggctgggattgcccgttccggaactgccagtccttggcgctctcttctgcccggcttttggccgactcggatgccgggggcccagaaaccaggcagtgggaaccagggccctagccccacctcttccgcgtggccatcacccgggaaaccacgccgcgactctagggccccgccccctcccgtgtttggtccggcgggcggcgcgtgccggctgggagttcag

SEQ ID NO: 29324 - DNA, 3130 bp, Homo sapiens
gatgcaactttccctttaagaaagccacctgggcgcaccgcggtgcggacccagcacgcctgggccgggggctgcagcatgctcttgagatctgtggcctgaaaggcgctggaagcagagcctgtgagtgtggtccccgtcaccagagccccaacccaccgccgccatggtaggaaaaggtgccaaagggatgctgaatggtgctgtgcccagcgaggccaccaagagggaccagaacctcaaacggggcaactggggcaaccagatcgagtttgtactgacgagcgtgggctatgccgtgggcctgggcaatgtctggcgcttcccatacctctgctatcgcaacgggggaggcgccttcatgttcccctacttcatcatgctcatcttctgcgggatccccctcttcttcatggagctctccttcggccagtttgcaagccaggggtgcctgggggtctggaggatcagccccatgttcaaaggagtgggctatggtatgatggtggtgtccacctacatcggcatctactacaatgtggtcatctgcatcgccttctactacttcttctcgtccatgacgcacgtgctgccctgggcctactgcaataacccctggaacacgcatgactgcgccggtgtactggacgcctccaacctcaccaatggctctcggccagccgccttgcccagcaacctctcccacctgctcaaccacagcctccagaggaccagccccagcgaggagtactggaggctgtacgtgctgaagctgtcagatgacattgggaactttggggaggtgcggctgcccctccttggctgcctcggtgtctcctggttggtcgtcttcctctgcctcatccgaggggtcaagtcttcagggaaagtggtgtacttcacggccacgttcccctacgtggtgctgaccattctgtttgtccgcggagtgaccctggagggagcctttgacggcatcatgtactacctaaccccgcagtgggacaagatcctggaggccaaggtgtggggtgatgctgcctcccagatcttctactcactgggctgcgcgtggggaggcctcatcaccatggcttcctacaacaagttccacaataactgttaccgggacagtgtcatcatcagcatcaccaactgtgccaccagcgtctatgctggcttcgtcatcttctccatcctcggcttcatggccaatcacctgggcgtggatgtgtcccgtgtggcagaccacggccctggcctggccttcgtggcttaccccgaggccctcacactacttcccatctccccgctgtggtctctgctcttcttcttcatgcttatcctgctggggctgggcactcagttctgcctcctggagacgctggtcacagccattgtggatgaggtggggaatgagtggatcctgcagaaaaagacctatgtgaccttgggcgtggctgtggctggcttcctgctgggcatccccctcaccagccaggcaggcatctattggctgctgctgatggacaactatgcggccagcttctccttggtggtcatctcctgcatcatgtgtgtggccatcatgtacatctacgggcaccggaactacttccaggacatccagatgatgctgggattcccaccacccctcttctttcagatctgctggcgcttcgtctctcccgccatcatcttctttattctagttttcactgtgatccagtaccagccgatcacctacaaccactaccagtacccaggctgggccgtggccattggcttcctcatggctctgtcctccgtcctctgcatccccctctacgccatgttccggctctgccgcacagacggggacaccctcctccagcgtttgaaaaatgccacaaagccaagcagagactggggccctgccctcctggagcaccggacagggcgctacgcccccaccatagccccctctcctgaggacggcttcgaggtccagccactgcacccggacaaggcgcagatccccattgtgggcagtaatggctccagccgcctccaggactcccggatatgagcacagctgccaggggagtggccccacccccaccccgtgctcccaccgcagagactggtgaggcagaggccaggtgtctctgcctgccccctgccacgccctggccaggacggctgctgtcaccttggtcaccactgctagtgcagtcattcatgctcatgtccccagtgtttacatgtcctttggatgccaagatagcagctggggggaggggtgggagtggagggttgctgggaggtccaaagcactttggaggggtctcgggccaggtccccagcagcctggatggctttacgtggcctccgatacccttataccctgccctgagctgaggttctgggtgggcctccagccccatgactagtgctcctgccctcagagccgaccccagcctctgccaggcacatttggctattcctccctaggggcaggatgaagggctgggggactgcccagtgttacttgtcaggctgtgctgcccagccctgtttatctgtgtaattatttttgtaaacattgtattctctgtggtcgccacctcctcgcccccagcctcgggttcagtctgtcttccaggcctgcttgcacctcactgggctgctccggggtctctgcccctcattccaggcctggctgtcaggcccagccagcaggggcccgtgacccagcagcctgcccaaagcatttgtttctgggggatggggtgggggctgctccacaggaggtttgagcccagcaccctggggaaggggaccctgcacgacacccccttgccctccctccatgaggctaaaggcccagtcttcccaaatgtgctgccctcgttcatgtgccaaatggccccagcccacatgcccctcccctctctggagtgggagccccttctgaagtgtctgaatccctgaagtgttcatttgtccgtcctctgtgcagtgacagccccggccaagccacctctaatcctctgtagcaataacggtgcgccgcccatccctgcccattgtgcaccactaggattttaaagtccatagattttaatgaaatttctattcctgtctctga

SEQ ID NO: 29325 - DNA, 1881 bp, Homo sapiens
gatgcaactttccctttaagaaagccacctgggcgcaccgcggtgcggacccagcacgcctgggccgggggctgcagcatgctcttgagatctgtggcctgaaaggcgctggaagcagagcctgtgagtgtggtccccgtcaccagagccccaacccaccgccgccatggtaggaaaaggtgccaaagggatgctggagtgggctatggtatgatggtggtgtccacctacatcggcatctactacaatgtggtcatctgcatcgccttctactacttcttctcgtccatgacgcacgtgctgccctgggcctactgcaataacccctggaacacgcatgactgcgccggtgtactggacgcctccaacctcaccaatggctctcggccagccgccttgcccagcaacctctcccacctgctcaaccacagcctccagaggaccagccccagcgaggagtactggaggctgtacgtgctgaagctgtcagatgacattgggaactttggggaggtgcggctgcccctccttggctgcctcggtgtctcctggttggtcgtcttcctctgcctcatccgaggggtcaagtcttcagggaaagtggtgtacttcacggccacgttcccctacgtggtgctgaccattctgtttgtccgcggagtgaccctggagggagcctttgacggcatcatgtactacctaaccccgcagtgggacaagatcctggaggccaaggtgtggggtgatgctgcctcccagatcttctactcactgggctgcgcgtggggaggcctcatcaccatggcttcctacaacaagttccacaataactgttaccgggacagtgtcatcatcagcatcaccaactgtgccaccagcgtctatgctggcttcgtcatcttctccatcctcggcttcatggccaatcacctgggcgtggatgtgtcccgtgtggcagaccacggccctggcctggccttcgtggcttaccccgaggccctcacactacttcccatctccccgctgtggtctctgctcttcttcttcatgcttatcctgctggggctgggcactcagttctgcctcctggagacgctggtcacagccattgtggatgaggtggggaatgagtggatcctgcagaaaaagacctatgtgaccttgggcgtggctgtggctggcttcctgctgggcatccccctcaccagccaggcaggcatctattggctgctgctgatggacaactatgcggccagcttctccttggtggtcatctcctgcatcatgtgtgtggccatcatgtacatctacgggcaccggaactacttccaggacatccagatgatgctgggattcccaccacccctcttctttcagatctgctggcgcttcgtctctcccgccatcatcttctttattctagttttcactgtgatccagtaccagccgatcacctacaaccactaccagtacccaggctgggccgtggccattggcttcctcatggctctgtcctccgtcctctgcatccccctctacgccatgttccggctctgccgcacagacggggacaccctcctccagcgtttgaaaaatgccacaaagccaagcagagactggggccctgccctcctggagcaccggacagggcgctacgcccccaccatagccccctctcctgaggacggcttcgaggtccagccactgcacccggacaaggcgcagatccccattgtgggcagtaatggctccagccgcctccaggactcccggatatgagcacagctgccaggggagtggccccacccccaccccgtgctcccaccgcagagactggtgaggcagaggccaggtgtctctgcctgccccctgccacgccct

SEQ ID NO: 29326 - DNA, 524 bp, Homo sapiens
aacaaaccccacacaccccactccagctccggagcacccgtgctgggctgcatggggactggccggaggggcagggccaggggagcgggtaggcagagcttcgggaggagatgaggtgtgaatgagcggcggagacacgcgggctgcgatcgctcgccccaggatggccgcggctcatggacctgtggccccctcttccccagaacagaatggtgctgtgcccagcgaggccaccaagagggaccagaacctcaaacggggcaactggggcaaccagatcgagtttgtactgacgagcgtgggctatgccgtgggcctgggcaatgtctggcgcttcccatacctctgctatcgcaacgggggaggcgccttcatgttcccctacttcatcatgctcatcttctgcgggatccccctcttcttcatggagctctccttcggccagtttgcaagccaggggtgcctgggggtctggaggatcagccccatgttcaaaggagtgggctatggtatgatggtggtgt

SEQ ID NO: 29327 - DNA, 1577 bp, Homo sapiens
acaacaggctgtggaagagctgcgagcggcgcggcggggcgggcgaactcggcgcggcacagagcctcgggaggctgatgcaactttccctttaagaaagccacctgggcgcaccgcggtgcggacccagcacgcctgggccgggggctgcagcatgctcttgagatctgtggcctgaaaggcgctggaagcagagcctgtgagtgtggtccccgtcaccagagccccaacccaccgccgccatggtaggaaaaggtgccaaagggatgctggcgccttcatgttcccctacttcatcatgctcatcttctgcgggatccccctcttcttcatggagctctccttcggccagtttgcaagccaggggtgcctgggggtctggaggatcagccccatgttcaaaggagtgggctatggtatgatggtggtgtccacctacatcggcatctactacaatgtggtcatctgcatcgccttctactacttcttctcgtccatgacgcacgtgctgccctgggcctactgcaataacccctggaacacgcatgactgcgccggtgtactggacgcctccaacctcaccaatggctctcggccagccgccttgcccagcaacctctcccacctgctcaaccacagcctccagaggaccagccccagcgaggagtactggaggctgtacgtgctgaagctgtcagatgacattgggaactttggggaggtgcggctgcccctccttggctgcctcggtgtctcctggttggtcgtcttcctctgcctcatccgaggggtcaagtcttcagggaaagtggtgtacttcacggccacgttcccctacgtggtgctgaccattctgtttgtccgcggagtgaccctggagggagcctttgacggcatcatgtactacctaaccccgcagtgggacaagatcctggaggccaaggtgtggggtgatgctgcctcccagatcttctactcactgggctgcgcgtggggaggcctcatcaccatggcttcctacaacaagttccacaataactgttaccgggacagtgtcatcatcagcatcaccaactgtgccaccagcgtctatgctggcttcgtcatcttctccatcctcggcttcatggccaatcacctgggcgtggatgtgtcccgtgtggcagaccacggccctggcctggccttcgtggcttaccccgaggccctcacactacttcccatctccccgctgtggtctctgctcttcttcttcatgcttatcctgctggggctgggcactcagttctgcctcctggagacgctggtcacagccattgtggatgaggtggggaatgagtggatcctgcagaaaaagacctatgtgaccttgggcgtggctgtggctggcttcctgctgggcatccccctcaccagccaggcatctattggctgctgctgatggacaactatgcggccagcttctccttggtggtcatctcctgcatcatgtgtgtggccatcatgtacatctacgggcaccggaactacttccaggacatccagatgatgctgggattcccaccacccctcttctt

SEQ ID NO: 29328 - DNA, 3739 bp, Homo sapiens
agaaagccgagggtttccgtcgcgaacccccctccccactcgctcagggctctccaatccgcagctctgcgtgcgggggcgcgcgcatccccccgccgtccgtccgtcagctgtctgtctgggtgtctatgcgggcgcagcagtgcacccttccccagcctcgggcgctgcgcagggacagacaaggcattcgcagcgccctgcccgcgctccacgcccgcagccgccagacggcagcgcctgcgtccgtgcccgccccagccggtgcgcgggagccgcgggggcaaaggcgcagtggccagcggaccatctctcgtgccctcgctctctgcgctccggggcagctgagccccggccacccgctctccaagatgaagaagctccagggagctcacctccgcaagcctgtcaccccagacctgctgatgacccccagtgaccagggcgatgtcgacctggatgtggactttgctgcacaccgggggaactggacaggcaagctggacttcctgctgtcctgcattggctactgtgtaggcctggggaatgtctggcgcttcccctatcgagcgtacaccaatggaggaggcgccttcctcgtgccctacttcctcatgctggccatctgtggcatccccctcttcttcctggagctctccctgggccagttctccagcctagggcccctggctgtctggaaaatcagccctctcttcaaaggcgccggcgcagccatgctgctcatcgtgggcttggtggccatctactacaacatgatcatcgcctacgtgctcttctacctcttcgcctccctcaccagcgacctaccctgggagcactgtggcaactggtggaacacagaactctgcctggagcacagagtctccaaggacggcaacggggccctgcccctcaacctcacctgcaccgtcagccccagcgaggagtactggagccgctacgtcctccacatccaaggcagccagggcatcggcagccctggggagatccgctggaacctctgcctctgcctgctgctggcctgggtcatcgtgttcctctgtatcctcaagggtgtgaagtcttcgggcaaggtggtgtatttcacggccacgttcccctacctcatcctgctcatgctgctggtccgcggagtcaccctcccaggggcctggaagggcatccagttctatctcaccccccagttccaccacttgttgtcttccaaggtgtggattgaagctgctcttcagatcttctattccctgggtgtgggcttcggggggctcctcacctttgcctcctacaacacgtttcaccagaacatctatagagacactttcatcgtcactctgggcaacgccatcaccagcatcctggctggctttgccatcttctccgtgctgggctacatgtctcaggagctgggcgtgcctgtggaccaagtagccaaagcaggccctggcctggcctttgtcgtctacccacaggccatgaccatgctgcctctgtcacccttctggtcctttctcttcttcttcatgcttctgactctcggcctagatagccagtttgcttttctggagaccattgtgacagctgtgacagatgagttcccatactacctgcggcccaagaaggcggtgttctcagggctcatctgcgtggccatgtacctgatggggctgatcctcaccactgatgggggcatgtactggctggtccttctggatgactacagcgccagcttcgggctgatggtggtggttatcaccacgtgccttgccgtgacacgggtgtatggcattcagaggttctgccgagacatccacatgatgctgggcttcaagccgggcctctacttcagggcctgctggctgttcctgtccccagccacgctcttggccctcatggtgtatagcatcgtcaagtaccagccctcggagtatggcagttaccgcttcccgccctgggctgagctgctgggcatcctgatgggcctgctgtcctgcctcatgatcccagctggcatgctggtggctgtgcttcgagaagagggctcactctgggagcggctccaacaggccagccggccggccatggactggggaccatcgctggaggagaaccggacgggcatgtatgtggccacgctggctgggagccagtcaccaaagccactgatggtgcacatgcgcaagtacgggggcatcaccagcttcgagaacacggccatcgaggtggaccgtgagattgcagaggaggaggagtcgatgatgtgaggcaggaggcaggcgggcagaaggccctgcccgggacctcacagtcccttcttagaagcctgcaaaggtcagctgtgccctctgggattctgagaggctatgggggggcctgccatagggatgccagtcccccagtgggggtcccttctgcagcctctgcctctcctgaaacctctgacaaccccctacacacacacacaggcatactcagacccactcaaagctgagaatgatccaactcagccctactttgcggatggacatattaaggccaggaggggagggacttgccccaggtcgcatggcagaggggacttgaacccacgcctcctgaccagccagctccctttcccatggggcagccggcaccaccttctcatctctattcagggcctacacccctccctttttggggggagcctgtccccacacaccttagcacaaccagaatcttgagttgggcagggaaggtcagggctacagaggctcttgaggctccgaggccctggggatcaaaggtcaatgagttaggtggggagaaagatccctgggggctcctgtatgcaggactcctgaaggaggtgggagctgagggccctggaggatggggaaggtttgcagagagaggaagaagagggcagggtggggaggagctctgggccagaggatgctgagctgcctgggcagagaccaagagggttggagacactagttttaccaggttacaggagggttcaagacagaaggaaaactaacagagggggagccagggatgatggggtgggcaggggatttgcatgatgaggagtatcattccagatctgtgcagagcggatcggacgggacagggtggagcggggaggcctgtgcaaagtgggaaagagctgccggtggcctgagccagggtgctggggctgcgggtggggaaaggaggccccagcacttcagacaaagaccaccccttcacccactggaccccaagccgcaaaagctggggaggtaggaagggtcactgtgagggcccagggcccctctcttcccatctcccttgtcctggtggccttcagtgtctcttccagttccaggagctgctgggaagctggccttcattgttggtgacagggcaaccatgggactaggaggtggcccatacacatggctggctggtcctgaggccacccaccttgttccaggacatgggcccgggcccggtgtgggggtagacgcagagggcagagggtagcccttggtactgtgggtccctcaaagaggagagtggggtgcagaaatgcctcagcatggctcatgcacacagcattctcccgtggggcagggttccctcatgcaacaggcctccctgtggccagcctctctgcctgtctctcgctgcgtccccccaaccccttgtgttctattggttcattgttaataaatatcaaatgaggtcacgctcctta

SEQ ID NO: 29329 - DNA, 2858 bp, Homo sapiens
agcctcggcgtgcccccaggaccggtaaagttcctctcgccagccgcatccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagatgaaaacgagacaagggagaaggagagctaccaactcttgccagatatcctgctgaacagaaatccctgaagctgccttaattctcaaaaggagttaccgctcagctgggagccagttcctgctatatgatctgttttctagcctcgctaatgtgagactgaagcattcttaccaaagaaatcatttcctagtaaagaagcccattgaactcactttatttgtttatttccttcgaaagccaccgaagagagaaaaacagagaaggtgtgtagtgtggcggaaaaagcacagcatatagttttacagacttgggtctgcagctgactagctgggtggcctggggatagtggcttcatcttttggggcttcaagattctttgtctttaaaatcaggggttatatcagatcatcaaagttcccattccattaaagaaaaccctgcatgtatccataatgatgctctcctgttaaatttacaatgaaggaaacacatcacttaactgtaagaatttcccaaaatgaactgatgaccagtgatctctctatcagagaaatgtcagatttctagcctccagaactttgatttttctggacattcaatagttcctctttctcagatatttttcaactgatgccagaaacacttggtatttgtttttaatccaacccttttgttttgaggctttggagggtaacacattttcataccctgtgagtcccaggatccacagctctgctgtggtcttagaagccactgaaacattggtgaatgtgaagtcacttttggggtgcctgccctcatccctctgtctctctgcttccgtgtaaataaagactgtttcaattgtgtcctctctgtgtcatggactgttccaatgtcatgcagatttctgtgtctgatatggattttaaaagttgttctctttgtggaatataagtgtacagaataataaataatgtttcctgggctgtgta

SEQ ID NO: 29330 - DNA, 3551 bp, Homo sapiens
gtcagaagtctccaactcttgagttccggcgtgccccaacctctgtttccaaatttttccagcggacgcgcgcccttttctgggaaccctgcgtccgctcagcgcgcgctcatcccagtgtctaaggcgctcccgggtggtcttgggagttgcaagtagggaggaacggccgggtaaccacctcttttccctttatccaagcagagcctcggcgtgcccccaggaccggtaaagttcctctcgccagccgcatccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctgagcctgcctggaggagaaggaggaacccccatgccaatgtccaggtcacaggcatccgctgcgctcccacctcggacaccatcttgggattcctcccctggaagttgtcctttctgatcctctcttcttttcccatttacaaatgatttcgtgactgtagtttttgttcaccttctgtgcatctggcctgggggctgttagctcagaggagaggagcaaacaggaaaatgacttctgttctgtccccgctgttttgggggaagtctctcccactttgggatcctgctgaagctaggttcatgaggtcggaaatccccaccacatttgcctagactttgggcacaggagttcttagtccaccaaatcagagagaggatgggcttttgatcagatacccctcccaaaaaaaaaaaaaactaaaactaaagcaaaaatcaaacaaaatctggctgagtttagtggggtggttggggaaggtacatagaccctcctcttgcccaccctagacagccctctcatgtctgaacctcagcctgggagttagatttatttgtctctaaaatgaagtcagtggatagatgctttgagggattttgagtagaaacattcatagttaattttcactctggccaatctgagtttgatgtgtgtgttctggaacattcctccagcttttggtggtcagatggcccagagatatgggggacaggaggaagagggtaaatgaaccacagtgagcaggttctaggaggtacctgcatcagacaagctggtggaggccacgtggcaagccacatctactgaggcctcatgctgctcttgctctgtaagacacggagcccagaaacccatctgcacttcctgagacctgcctggggaaacgggggcagggaccaagtgaggcctcatgtgtgtcttcaccgtgctgtcctcacaaggccaggtgggtgcccaaagggagcctgacaggctgttgtgttaatttattgttcttgcacacctgcacagcctccctctggggatcccacctggagtggaccaggggtcttgagaaatggagagttggctgcaaaaactctcatgcactagatgtggcaccttggagggcagggtgagacaagcagcccagaaatactctctcaagtggaggggagaattttgagagtggatggaacagtttggtggtttcagagaatttctaggtttctacttggatctacttctgatacaaacttgcacttggtgccctctggtggtgtttagttttagttccgtaagagaaatgattcctagtttgctaaattggtggcatctttgggaggggtttctgtttatggttagagtctcttacacccttgttggagggattcttattctgactgtgggagctcctgttgcgggatcttgggaaaaaataaagaagccgctgcattcgcacgtcaa

SEQ ID NO: 29331 - DNA, 3887 bp, Homo sapiens
agagctggtgctgcaccggtcgctgcttccccagtccttttttggcctcctttctgacgcgacgcagaccccagttctggagagtctgtcactcgctccccgtggtgggagatcagaggcctggtgtccttgggagcggcgagcggtgctcggcgcaggatagaaagggagtgcgcgcccgagtcccccagatccctgggaacccgcgccaccctcccgcccctgcccatccccggccgcgctgtcagtctccattagcgctaacaggctccagacggagcgggccgggcgctgggttaatgcaatcggcgcgttacctggggcgcaggctacattaccagcccggcccccgccaggcacggccagaaccagtcagcccgcgccctgccggccgccccgcgcctccagctcttccccggccccgcccgaacgccacacggcggagcccagccccagcccgcgccctagagcctgccaaggcgccgccggtcgggggccggcagggcgcaaggcaccagggatcccctcgccgccggacacagcctcggcgtgcccccaggaccggtaaagttcctctcgccagccgcatccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctgagcctgcctggaggagaaggaggaacccccatgccaatgtccaggtcacaggcatccgctgcgctcccacctcggacaccatcttgggattcctcccctggaagttgtcctttctgatcctctcttcttttcccatttacaaatgatttcgtgactgtagtttttgttcaccttctgtgcatctggcctgggggctgttagctcagaggagaggagcaaacaggaaaatgacttctgttctgtccccgctgttttgggggaagtctctcccactttgggatcctgctgaagctaggttcatgaggtcggaaatccccaccacatttgcctagactttgggcacaggagttcttagtccaccaaatcagagagaggatgggcttttgatcagatacccctcccaaaaaaaaaaaaaactaaaactaaagcaaaaatcaaacaaaatctggctgagtttagtggggtggttggggaaggtacatagaccctcctcttgcccaccctagacagccctctcatgtctgaacctcagcctgggagttagatttatttgtctctaaaatgaagtcagtggatagatgctttgagggattttgagtagaaacattcatagttaattttcactctggccaatctgagtttgatgtgtgtgttctggaacattcctccagcttttggtggtcagatggcccagagatatgggggacaggaggaagagggtaaatgaaccacagtgagcaggttctaggaggtacctgcatcagacaagctggtggaggccacgtggcaagccacatctactgaggcctcatgctgctcttgctctgtaagacacggagcccagaaacccatctgcacttcctgagacctgcctggggaaacgggggcagggaccaagtgaggcctcatgtgtgtcttcaccgtgctgtcctcacaaggccaggtgggtgcccaaagggagcctgacaggctgttgtgttaatttattgttcttgcacacctgcacagcctccctctggggatcccacctggagtggaccaggggtcttgagaaatggagagttggctgcaaaaactctcatgcactagatgtggcaccttggagggcagggtgagacaagcagcccagaaatactctctcaagtggaggggagaattttgagagtggatggaacagtttggtggtttcagagaatttctaggtttctacttggatctacttctgatacaaacttgcacttggtgccctctggtggtgtttagttttagttccgtaagagaaatgattcctagtttgctaaattggtggcatctttgggaggggtttctgtttatggttagagtctcttacacccttgttggagggattcttattctgactgtgggagctcctgttgcgggatcttgggaaaaaataaagaagccgctgcattcgcacgtcaa

SEQ ID NO: 29332 - DNA, 3752 bp, Homo sapiens
agagctggtgctgcaccggtcgctgcttccccagtccttttttggcctcctttctgacgcgacgcagaccccagttctggagagtctgtcactcgctccccgtggtgggagatcagaggcctggtgtccttgggagcggcgagcggtgctcggcgcaggatagaaagggagtgcgcgcccgagtcccccagatccctgggaacccgcgccaccctcccgcccctgcccatccccggccgcgctgtcagtctccattagcgctaacaggctccagacggagcgggccgggcgctgggttaatgcaatcggcgcgttacctggggcgcaggctacattaccagcccggcccccgccaggcacggccagaaccagtcagcccgcgccctgccggccgccccgcgcctccagctcttccccggccccgcccgaacgccacacggcggagcccagccccagcccgcgccctagagcctgccaaggcgccgccggtcgggggccggcagggcgcaaggcaccagggatcccctcgccgccggacacagcctcggcgtgcccccaggaccggtaaagttcctctcgccagccgcatccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctgagcctgcctggaggagaaggaggaacccccatgccaatgtccaggtcacaggcatccgctgcgctcccacctcggacaccatcttgggattcctcccctggaagttgtcctttctgatcctctcttcttttcccatttacaaatgatttcgtgactgtagtttttgttcaccttctgtgcatctggcctgggggctgttagctcagaggagaggagcaaacaggaaaatgacttctgttctgtccccgctgttttgggggaagtctctcccactttgggatcctgctgaagctaggttcatgaggtcggaaatccccaccacatttgcctagactttgggcacaggagttcttagtccaccaaatcagagagaggatgggcttttgatcagatacccctcccaaaaaaaaaaaaaactaaaactaaagcaaaaatcaaacaaaatctggctgagtttagtggggtggttggggaaggtacatagaccctcctcttgcccaccctagacagccctctcatgtctgaacctcagcctgggagttagatttatttgtctctaaaatgaagtcagtggatagatgctttgagggattttgagtagaaacattcatagttaattttcactctggccaatctgagtttgatgtgtgtgttctggaacattcctccagcttttggtggtcagatggcccagagatatgggggacaggaggaagagggtaaatgaaccacagtgagcaggttctaggaggtacctgcatcagacaagctggtggaggccacgtggcaagccacatctactgaggcctcatgctgctcttgctctgtaagacacggagcccagaaacccatctgcacttcctgagacctgcctggggaaacgggggcagggaccaagtgaggcctcatgtgtgtcttcaccgtgctgtcctcacaaggccaggtgggtgcccaaagggagcctgacaggctgttgtgttaatttattgttcttgcacacctgcacagcctccctctggggatcccacctggagtggaccaggggtcttgagaaatggagagttggctgcaaaaactctcatgcactagatgtggcaccttggagggcagggtgagacaagcagcccagaaatactctctcaagtggaggggagaattttgagagtggatggaacagtttggtggtttcagagaatttctaggtttctacttggatctacttctgatacaaacttgcacttggtgccctctggtggtgtttagttttagttccgtaagagaaatgattcctagtttgctaaattggtggcatctttgggaggggtttctgtttatggttagagtctcttacacccttgttggagggattcttattctgactgtgggagctcctgttgcgggatcttgggaaaaaataaagaagccgctgcattcgcacgtcaa

SEQ ID NO: 29333 - DNA, 4516 bp, Homo sapiens
ggtccctcccctcctggctctggggtcgggcgcgcaccccgccccgtagcgcggcccctccctggcgagcgcaaccccatccagcgggagcgcggagccgcggccgcggggaagcattaagtttattcgcctcaaagtgacgcaaaaattcttcaagagctctttggcggcggctatctagagatcagaccatgtgagggcccgcgggtacaaatacggccgcgccggcgcccctccgcacagccagcgccgccgggtgcctcgagggcgcgaggccagcccgcctgcccagcccgggaccagcctccccgcgcagcctggcaggtctcctggaggcaaggcgaccttgcttgccctctcttgcagaataacaaggggcttagccacaggagttgctggcaagtggaaagaagaacaaatgagtcaatcccgacgtgtcaatcccgacgatagagagctcggaggtgatccacaaatccaagcacccagagatcaattgggatccttggcagatggacatcagtgtcatttactaaccagcaggatggagacgacgcccttgaattctcagaagcagctatcagcgtgtgaagatggagaagattgtcaggaaaacggagttctacagaaggttgttcccaccccaggggacaaagtggagtccgggcaaatatccaatgggtactcagcagttccaagtcctggtgcgggagatgacacacggcactctatcccagcgaccaccaccaccctagtggctgagcttcatcaaggggaacgggagacctggggcaagaaggtggatttccttctctcagtgattggctatgctgtggacctgggcaatgtctggcgcttcccctacatatgttaccagaatggagggggggcattcctcctcccctacaccatcatggccatttttgggggaatcccgctcttttacatggagctcgcactgggacagtaccaccgaaatggatgcatttcaatatggaggaaaatctgcccgattttcaaagggattggttatgccatctgcatcattgccttttacattgcttcctactacaacaccatcatggcctgggcgctatactacctcatctcctccttcacggaccagctgccctggaccagctgcaagaactcctggaacactggcaactgcaccaattacttctccgaggacaacatcacctggaccctccattccacgtcccctgctgaagaattttacacgcgccacgtcctgcagatccaccggtctaaggggctccaggacctggggggcatcagctggcagctggccctctgcatcatgctgatcttcactgttatctacttcagcatctggaaaggcgtcaagacctctggcaaggtggtgtgggtgacagccaccttcccttatatcatcctttctgtcctgctggtgaggggtgccaccctccctggagcctggaggggtgttctcttctacttgaaacccaattggcagaaactcctggagacaggggtgtggatagatgcagccgctcagatcttcttctctcttggtccgggctttggggtcctgctggcttttgctagctacaacaagttcaacaacaactgctaccaagatgccctggtgaccagcgtggtgaactgcatgacgagcttcgtttcgggatttgtcatcttcacagtgctcggttacatggctgagatgaggaatgaagatgtgtctgaggtggccaaagacgcaggtcccagcctcctcttcatcacgtatgcagaagcgatagccaacatgccagcgtccactttctttgccatcatcttctttctgatgttaatcacgctgggcttggacagcacgtttgcaggcttggagggggtgatcacggctgtgctggatgagttcccacacgtctgggccaagcgccgggagcggttcgtgctcgccgtggtcatcacctgcttctttggatccctggtcaccctgacttttggaggggcctacgtggtgaagctgctggaggagtatgccacggggcccgcagtgctcactgtcgcgctgatcgaagcagtcgctgtgtcttggttctatggcatcactcagttctgcagggacgtgaaggaaatgctcggcttcagcccggggtggttctggaggatctgctgggtggccatcagccctctgtttctcctgttcatcatttgcagttttctgatgagcccgccacaactacgacttttccaatataattatccttactggagtatcatcttgggttactgcataggaacctcatctttcatttgcatccccacatatatagcttatcggttgatcatcactccagggacatttaaagagcgtattattaaaagtattaccccagaaacaccaacagaaattccttgtggggacatccgcttgaatgctgtgtaacacactcaccgagaggaaaaaggcttctccacaacctcctcctccagttctgatgaggcacgcctgccttctcccctccaagtgaatgagtttccagctaagcctgatgatggaagggccttctccacagggacacagtctggtgcccagactcaaggcctccagccacttatttccatggattcccctggacatattcccatggtagactgtgacacagctgagctggcctattttggacgtgtgaggatgtggatggaggtgatgaaaaccaccctatcatcagttaggattaggtttagaatcaagtctgtgaaagtctcctgtatcatttcttggtatgatcattggtatctgatatctgtttgcttctaaaggtttcactgttcatgaatacgtaaactgcgtaggagagaacagggatgctatctcgctagccatatattttctgagtagcatatataattttattgctggaatctactagaaccttctaatccatgtgctgctgtggcatcaggaaaggaagatgtaagaagctaaaatgaaaaatagtgtgtccatgcaagcttgtgagtctgtgtatattgttgtttcagtgtattcttatctctagtccaatattttgggcccattacaaatatatgaattccccaaatttttcttacattaacaaattctaccaactcaattgtgtatggaggttattatttgaagggtacaatcactacaacatgctctgccacccactccttttccagtgacactacttgagccacacactttcctttacaggccagcctctggcgtttgctgcacctcattgccaccttcctgtctctctgtgctaaacattcaggacagtgttccacaggcagatctggcctatttcattagtcaccatggcttggctgtgaagtacgttgaaggtggatcttgtcacatgccccttcagtgttcacctggccctctggtttaagttctgtctgccttacgtgactgagtttgactgtccaggttgctttgctcggtgaagagaggagggtaaatcggattctcgtttagcactgggttatacagatctggcaccctaacctaaaccaaggcatcttcactccaagagcagttggagagtctgggttagccttacgtggacctcgccgctcgctggcggtcacgattgtgagccctccagataatttttaaggttgagtctaagtaaggctgcttgggaaatggtcagctaagtaaatcacctttcatttcacataaggcccttaatatagataagtaaatttggcctttggtgtctcgtgactctcagaggcgtaggtagaggagcaaattaatatttgcagcatgggaattccttatcagaattttgaggggaataaatcctcatcagagacaaaaggacttaatcatctggccacctatcacttcagttctctgtataaatgaaatttaattctaacaaccttataaaaagaaggtccagacagcagaggaaacatcctgtccaattctaggttttcctcccttggcctcctttccccagcattgtctaccctggcccacttcctgcattctccccatgccctgctatttctgattctttgcttctcctagcgagatactttccttatatgatagctgctgagaagtttcccagaactgctagaggaaaagaagtggggaatttaggaaatatccctcactgacctaactccattatcttcactctttccttcttcctgccacctcatgcccattctctttactgtctagcatgctgaaagaaggaagtgatctaaatgccagcgtgttcagtggtaaatattagttggtgcaaaagaaaaaccatgattacttttgcactaacctaatagctttgcaaattttaagaacttgctttatgaagatattcggatatggattctccccaccccacatacttagacattgttcaaatatactacttttaaaaaaacaccttttcaaacagaattagcgttttgccaagtctggtattaatggaattgtacaggagctttgaaagttttcaaactttattaaact

SEQ ID NO: 29334 - DNA, 6335 bp, Homo sapiens
acagccagcgccgccgggtgcctcgagggcgcgaggccagcccgcctgcccagcccgggaccagcctccccgcgcagcctggcaggtctcctggaggcaaggcgaccttgcttgccctctcttgcagaataacaaggggcttagccacaggagttgctggcaagtggaaagaagaacaaatgagtcaatcccgacgtgtcaatcccgacgatagagagctcggaggtgatccacaaatccaagcacccagagatcaattgggatccttggcagatggacatcagtgtcatttactaaccagcaggatggagacgacgcccttgaattctcagaagcagctatcagcgtgtgaagatggagaagattgtcaggaaaacggagttctacagaaggttgttcccaccccaggggacaaagtggagtccgggcaaatatccaatgggtactcagcagttccaagtcctggtgcgggagatgacacacggcactctatcccagcgaccaccaccaccctagtggctgagcttcatcaaggggaacgggagacctggggcaagaaggtggatttccttctctcagtgattggctatgctgtggacctgggcaatgtctggcgcttcccctacatatgttaccagaatggagggggggcattcctcctcccctacaccatcatggccatttttgggggaatcccgctcttttacatggagctcgcactgggacagtaccaccgaaatggatgcatttcaatatggaggaaaatctgcccgattttcaaagggattggttatgccatctgcatcattgccttttacattgcttcctactacaacaccatcatggcctgggcgctatactacctcatctcctccttcacggaccagctgccctggaccagctgcaagaactcctggaacactggcaactgcaccaattacttctccgaggacaacatcacctggaccctccattccacgtcccctgctgaagaattttacacgcgccacgtcctgcagatccaccggtctaaggggctccaggacctggggggcatcagctggcagctggccctctgcatcatgctgatcttcactgttatctacttcagcatctggaaaggcgtcaagacctctggcaaggtggtgtgggtgacagccaccttcccttatatcatcctttctgtcctgctggtgaggggtgccaccctccctggagcctggaggggtgttctcttctacttgaaacccaattggcagaaactcctggagacaggggtgtggatagatgcagccgctcagatcttcttctctcttggtccgggctttggggtcctgctggcttttgctagctacaacaagttcaacaacaactgctaccaagatgccctggtgaccagcgtggtgaactgcatgacgagcttcgtttcgggatttgtcatcttcacagtgctcggttacatggctgagatgaggaatgaagatgtgtctgaggtggccaaagacgcaggtcccagcctcctcttcatcacgtatgcagaagcgatagccaacatgccagcgtccactttctttgccatcatcttctttctgatgttaatcacgctgggcttggacagcacgtttgcaggcttggagggggtgatcacggctgtgctggatgagttcccacacgtctgggccaagcgccgggagcggttcgtgctcgccgtggtcatcacctgcttctttggatccctggtcaccctgacttttggaggggcctacgtggtgaagctgctggaggagtatgccacggggcccgcagtgctcactgtcgcgctgatcgaagcagtcgctgtgtcttggttctatggcatcactcagttctgcagggacgtgaaggaaatgctcggcttcagcccggggtggttctggaggatctgctgggtggccatcagccctctgtttctcctgttcatcatttgcagttttctgatgagcccgccacaactacgacttttccaatataattatccttactggagtatcatcttgggttactgcataggaacctcatctttcatttgcatccccacatatatagcttatcggttgatcatcactccagggacatttaaagagcgtattattaaaagtattaccccagaaacaccaacagaaattccttgtggggacatccgcttgaatgctgtgtaacacactcaccgagaggaaaaaggcttctccacaacctcctcctccagttctgatgaggcacgcctgccttctcccctccaagtgaatgagtttccagctaagcctgatgatggaagggccttctccacagggacacagtctggtgcccagactcaaggcctccagccacttatttccatggattcccctggacatattcccatggtagactgtgacacagctgagctggcctattttggacgtgtgaggatgtggatggaggtgatgaaaaccaccctatcatcagttaggattaggtttagaatcaagtctgtgaaagtctcctgtatcatttcttggtatgatcattggtatctgatatctgtttgcttctaaaggtttcactgttcatgaatacgtaaactgcgtaggagagaacagggatgctatctcgctagccatatattttctgagtagcatatataattttattgctggaatctactagaaccttctaatccatgtgctgctgtggcatcaggaaaggaagatgtaagaagctaaaatgaaaaatagtgtgtccatgcaagcttgtgagtctgtgtatattgttgtttcagtgtattcttatctctagtccaatattttgggcccattacaaatatatgaattccccaaatttttcttacattaacaaattctaccaactcaattgtgtatggaggttattatttgaagggtacaatcactacaacatgctctgccacccactccttttccagtgacactacttgagccacacactttcctttacaggccagcctctggcgtttgctgcacctcattgccaccttcctgtctctctgtgctaaacattcaggacagtgttccacaggcagatctggcctatttcattagtcaccatggcttggctgtgaagtacgttgaaggtggatcttgtcacatgccccttcagtgttcacctggccctctggtttaagttctgtctgccttacgtgactgagtttgactgtccaggttgctttgctcggtgaagagaggagggtaaatcggattctcgtttagcactgggttatacagatctggcaccctaacctaaaccaaggcatcttcactccaagagcagttggagagtctgggttagccttacgtggacctcgccgctcgctggcggtcacgattgtgagccctccagataatttttaaggttgagtctaagtaaggctgcttgggaaatggtcagctaagtaaatcacctttcatttcacataaggcccttaatatagataagtaaatttggcctttggtgtctcgtgactctcagaggcgtaggtagaggagcaaattaatatttgcagcatgggaattccttatcagaattttgaggggaataaatcctcatcagagacaaaaggacttaatcatctggccacctatcacttcagttctctgtataaatgaaatttaattctaacaaccttataaaaagaaggtccagacagcagaggaaacatcctgtccaattctaggttttcctcccttggcctcctttccccagcattgtctaccctggcccacttcctgcattctccccatgccctgctatttctgattctttgcttctcctagcgagatactttccttatatgatagctgctgagaagtttcccagaactgctagaggaaaagaagtggggaatttaggaaatatccctcactgacctaactccattatcttcactctttccttcttcctgccacctcatgcccattctctttactgtctagcatgctgaaagaaggaagtgatctaaatgccagcgtgttcagtggtaaatattagttggtgcaaaagaaaaaccatgattacttttgcactaacctaatagctttgcaaattttaagaacttgctttatgaagatattcggatatggattctccccaccccacatacttagacattgttcaaatatactacttttaaaaaaacaccttttcaaacagaattagcgttttgccaagtctggtattaatggaattgtacaggagctttgaaagttttcaaactttattaaactaaaaaaaaaaaatcgaaaatctctgtctgttccgcatagtatgcatttatttgacccctatttatcaatactatgatggggttttttttttttaaagaaaatttaagagtaggtaggtggattttaaaataatattttaaagaccttttatatctatatgtagcatttatagaaaaataaaaactaaaaatagaattgaattgtaacattatttaaggactgaagttttttttcttgtatcagtaagaaatacccaagaggctgggtgcagtgactcacacctgtaatcccagcactttgggaggctgcagtgggaggatcacatgacatcaggagtttgagaccagcttggccaacatagtgaaacgccgtctctattaaaaatacagaaaattagctgaatgtggtggcaggcgcctataattcctgctacttgggaggctgaggcaggagaattgcttgaacccaggaggcagaggttgcagtgagccaaacgttccactgcattccagcctggatgacaagagcgaaactccgtctcaaaaaaaaaaaaaaaaattgttatgcttagttccatggaaagactattctgaagctttaagtcttctttttctattttccatagtattgccccttccccacttcattgcttaactgtctctaaattttaatgataataatattttaaaggtcagataatgccattagaggcagagacaaacctggggaccaagctaatttctctgttattgagagcgctaaagacaggtgaactggagttttatttcctctgctagagtgaaataataccctctccaccaggcacaatggctcacacctgtaattccagcactttgggaggccaaggtgggcggatcacttgaggtcaggagttcgagaccagcctggccaacatggtgaaaccccatctctactaaaaatacaaaaattagccagccatggtggcatgctcctgtaatcccagctacttgggagactgaggtgggataatcacttgaacctgggaggcggaggttgcagtgagctgagattgtgccactgcactccagcctgggtgacagagcaagactccatctaaaaaacaaaaacaaaaacaaaaaaaccctctcaattggtttaataccacgatagaaaagataaatattttaggatggaatcttaaatatgtctgtccttttgtttcatatagttgaaatcaattcagtattgtttctacattaggtgtttcaaaaacagtcacctttgcaacagaagagctcttttgttgaaaatgattcacaatatatttcagttggaatgtcaggtggtatttctcttaccaacacctcacagaatctatgccaagctgctctaccaccaatgcaagtatttttttaaagctactaaaataaactttcttcaccagccaactctaatttggagacagtgtgcattggtgaaggacctcgtcagaataagtttgaatgtctactgaactaagaagaattttgtcgtttgggggagagaatagatggcatcagtccttcaattctgtaactgaagactccaattatagtagataagaattgtgtctagcaatttttaaacactgacagtccaaacaaaaatatttggtgaggaaggatgtcccatatttttgcttaaatatcataaacaaatatgagcatttactaattttttaaatggcattttgaaagattattcttatttacactctaaaattaaaggtgtactttatcttaagaaaatgatatattaaaaattcatattttaaaagataaaattggggaatttacagttattttgtgaatggcctttaaactatgatttgatctatatacaacttttcagaatacttttgattgtgtgttggacatatctaaaattaattttatctggcagaattaaacctaaatttatttgtataaaagagtcccctttctaaaattcatacagtgcccttgtattcatttatgcagtgtttataaatatttcaagttagattgtgagatattaataaatgatttatgctgtgaa

SEQ ID NO: 29335 - DNA, 6192 bp, Homo sapiens
tgcccagcccgggaccagcctccccgcgcagcctggcagagtcaatcccgacgtgtcaatcccgacgatagagagctcggaggtgatccacaaatccaagcacccagagatcaattgggatccttggcagatggacatcagtgtcatttactaaccagcaggatggagacgacgcccttgaattctcagaagcagctatcagcgtgtgaagatggagaagattgtcaggaaaacggagttctacagaaggttgttcccaccccaggggacaaagtggagtccgggcaaatatccaatgggtactcagcagttccaagtcctggtgcgggagatgacacacggcactctatcccagcgaccaccaccaccctagtggctgagcttcatcaaggggaacgggagacctggggcaagaaggtggatttccttctctcagtgattggctatgctgtggacctgggcaatgtctggcgcttcccctacatatgttaccagaatggagggggggcattcctcctcccctacaccatcatggccatttttgggggaatcccgctcttttacatggagctcgcactgggacagtaccaccgaaatggatgcatttcaatatggaggaaaatctgcccgattttcaaagggattggttatgccatctgcatcattgccttttacattgcttcctactacaacaccatcatggcctgggcgctatactacctcatctcctccttcacggaccagctgccctggaccagctgcaagaactcctggaacactggcaactgcaccaattacttctccgaggacaacatcacctggaccctccattccacgtcccctgctgaagaattttacacgcgccacgtcctgcagatccaccggtctaaggggctccaggacctggggggcatcagctggcagctggccctctgcatcatgctgatcttcactgttatctacttcagcatctggaaaggcgtcaagacctctggcaaggtggtgtgggtgacagccaccttcccttatatcatcctttctgtcctgctggtgaggggtgccaccctccctggagcctggaggggtgttctcttctacttgaaacccaattggcagaaactcctggagacaggggtgtggatagatgcagccgctcagatcttcttctctcttggtccgggctttggggtcctgctggcttttgctagctacaacaagttcaacaacaactgctaccaagatgccctggtgaccagcgtggtgaactgcatgacgagcttcgtttcgggatttgtcatcttcacagtgctcggttacatggctgagatgaggaatgaagatgtgtctgaggtggccaaagacgcaggtcccagcctcctcttcatcacgtatgcagaagcgatagccaacatgccagcgtccactttctttgccatcatcttctttctgatgttaatcacgctgggcttggacagcacgtttgcaggcttggagggggtgatcacggctgtgctggatgagttcccacacgtctgggccaagcgccgggagcggttcgtgctcgccgtggtcatcacctgcttctttggatccctggtcaccctgacttttggaggggcctacgtggtgaagctgctggaggagtatgccacggggcccgcagtgctcactgtcgcgctgatcgaagcagtcgctgtgtcttggttctatggcatcactcagttctgcagggacgtgaaggaaatgctcggcttcagcccggggtggttctggaggatctgctgggtggccatcagccctctgtttctcctgttcatcatttgcagttttctgatgagcccgccacaactacgacttttccaatataattatccttactggagtatcatcttgggttactgcataggaacctcatctttcatttgcatccccacatatatagcttatcggttgatcatcactccagggacatttaaagagcgtattattaaaagtattaccccagaaacaccaacagaaattccttgtggggacatccgcttgaatgctgtgtaacacactcaccgagaggaaaaaggcttctccacaacctcctcctccagttctgatgaggcacgcctgccttctcccctccaagtgaatgagtttccagctaagcctgatgatggaagggccttctccacagggacacagtctggtgcccagactcaaggcctccagccacttatttccatggattcccctggacatattcccatggtagactgtgacacagctgagctggcctattttggacgtgtgaggatgtggatggaggtgatgaaaaccaccctatcatcagttaggattaggtttagaatcaagtctgtgaaagtctcctgtatcatttcttggtatgatcattggtatctgatatctgtttgcttctaaaggtttcactgttcatgaatacgtaaactgcgtaggagagaacagggatgctatctcgctagccatatattttctgagtagcatatataattttattgctggaatctactagaaccttctaatccatgtgctgctgtggcatcaggaaaggaagatgtaagaagctaaaatgaaaaatagtgtgtccatgcaagcttgtgagtctgtgtatattgttgtttcagtgtattcttatctctagtccaatattttgggcccattacaaatatatgaattccccaaatttttcttacattaacaaattctaccaactcaattgtgtatggaggttattatttgaagggtacaatcactacaacatgctctgccacccactccttttccagtgacactacttgagccacacactttcctttacaggccagcctctggcgtttgctgcacctcattgccaccttcctgtctctctgtgctaaacattcaggacagtgttccacaggcagatctggcctatttcattagtcaccatggcttggctgtgaagtacgttgaaggtggatcttgtcacatgccccttcagtgttcacctggccctctggtttaagttctgtctgccttacgtgactgagtttgactgtccaggttgctttgctcggtgaagagaggagggtaaatcggattctcgtttagcactgggttatacagatctggcaccctaacctaaaccaaggcatcttcactccaagagcagttggagagtctgggttagccttacgtggacctcgccgctcgctggcggtcacgattgtgagccctccagataatttttaaggttgagtctaagtaaggctgcttgggaaatggtcagctaagtaaatcacctttcatttcacataaggcccttaatatagataagtaaatttggcctttggtgtctcgtgactctcagaggcgtaggtagaggagcaaattaatatttgcagcatgggaattccttatcagaattttgaggggaataaatcctcatcagagacaaaaggacttaatcatctggccacctatcacttcagttctctgtataaatgaaatttaattctaacaaccttataaaaagaaggtccagacagcagaggaaacatcctgtccaattctaggttttcctcccttggcctcctttccccagcattgtctaccctggcccacttcctgcattctccccatgccctgctatttctgattctttgcttctcctagcgagatactttccttatatgatagctgctgagaagtttcccagaactgctagaggaaaagaagtggggaatttaggaaatatccctcactgacctaactccattatcttcactctttccttcttcctgccacctcatgcccattctctttactgtctagcatgctgaaagaaggaagtgatctaaatgccagcgtgttcagtggtaaatattagttggtgcaaaagaaaaaccatgattacttttgcactaacctaatagctttgcaaattttaagaacttgctttatgaagatattcggatatggattctccccaccccacatacttagacattgttcaaatatactacttttaaaaaaacaccttttcaaacagaattagcgttttgccaagtctggtattaatggaattgtacaggagctttgaaagttttcaaactttattaaactaaaaaaaaaaaatcgaaaatctctgtctgttccgcatagtatgcatttatttgacccctatttatcaatactatgatggggttttttttttttaaagaaaatttaagagtaggtaggtggattttaaaataatattttaaagaccttttatatctatatgtagcatttatagaaaaataaaaactaaaaatagaattgaattgtaacattatttaaggactgaagttttttttcttgtatcagtaagaaatacccaagaggctgggtgcagtgactcacacctgtaatcccagcactttgggaggctgcagtgggaggatcacatgacatcaggagtttgagaccagcttggccaacatagtgaaacgccgtctctattaaaaatacagaaaattagctgaatgtggtggcaggcgcctataattcctgctacttgggaggctgaggcaggagaattgcttgaacccaggaggcagaggttgcagtgagccaaacgttccactgcattccagcctggatgacaagagcgaaactccgtctcaaaaaaaaaaaaaaaaattgttatgcttagttccatggaaagactattctgaagctttaagtcttctttttctattttccatagtattgccccttccccacttcattgcttaactgtctctaaattttaatgataataatattttaaaggtcagataatgccattagaggcagagacaaacctggggaccaagctaatttctctgttattgagagcgctaaagacaggtgaactggagttttatttcctctgctagagtgaaataataccctctccaccaggcacaatggctcacacctgtaattccagcactttgggaggccaaggtgggcggatcacttgaggtcaggagttcgagaccagcctggccaacatggtgaaaccccatctctactaaaaatacaaaaattagccagccatggtggcatgctcctgtaatcccagctacttgggagactgaggtgggataatcacttgaacctgggaggcggaggttgcagtgagctgagattgtgccactgcactccagcctgggtgacagagcaagactccatctaaaaaacaaaaacaaaaacaaaaaaaccctctcaattggtttaataccacgatagaaaagataaatattttaggatggaatcttaaatatgtctgtccttttgtttcatatagttgaaatcaattcagtattgtttctacattaggtgtttcaaaaacagtcacctttgcaacagaagagctcttttgttgaaaatgattcacaatatatttcagttggaatgtcaggtggtatttctcttaccaacacctcacagaatctatgccaagctgctctaccaccaatgcaagtatttttttaaagctactaaaataaactttcttcaccagccaactctaatttggagacagtgtgcattggtgaaggacctcgtcagaataagtttgaatgtctactgaactaagaagaattttgtcgtttgggggagagaatagatggcatcagtccttcaattctgtaactgaagactccaattatagtagataagaattgtgtctagcaatttttaaacactgacagtccaaacaaaaatatttggtgaggaaggatgtcccatatttttgcttaaatatcataaacaaatatgagcatttactaattttttaaatggcattttgaaagattattcttatttacactctaaaattaaaggtgtactttatcttaagaaaatgatatattaaaaattcatattttaaaagataaaattggggaatttacagttattttgtgaatggcctttaaactatgatttgatctatatacaacttttcagaatacttttgattgtgtgttggacatatctaaaattaattttatctggcagaattaaacctaaatttatttgtataaaagagtcccctttctaaaattcatacagtgcccttgtattcatttatgcagtgtttataaatatttcaagttagattgtgagatattaataaatgatttatgctgtgaa

SEQ ID NO: 29336 - DNA, 6506 bp, Homo sapiens
gagagctgcctgctcagacaacagacacgcgaggtcaggaagaagccgcttataaattaccgcttccttcgcgccgccgccaacgccgagccccgaggaccgcaagcccagaggacaagctgcgccaagagggagtgctggagctgttcacccagcgggtcagagagcgagccgggcaggccagcccccggccggcggaaccctggcacagcctgagcagatgctgcgggcggcgccgcagccaccccagatccagaaccagaaccacagcccttctgaggagctcccaaacaaagcaaggagatggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgcgtttctcataccgtattttattttcctgtttgggagcggcctgcctgtgtttttcttggagatcatcataggccagtacacctctgaagggggcatcacctgctgggaaaagatctgccccttgttctctggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagcgcaacgtgctgagcttgtcccctggaatcgaccacccaggctctctgaaatgggacctcgctctctgccttcttttagtctggctagtgtgtttcttctgcatctggaagggcgtcaggtccactgggaaggtcgtctacttcacagccacttttccattcgccatgctcctggtgctgctggtccgagggctgacgctgccgggcgcgggcgcaggcatcaagttctatctgtatcctgacatcacccgccttgaggacccacaggtgtggattgacgctgggactcagatattcttctcttatgccatctgcctgggggctatgacctcgctggggagctacaacaagtacaagtataactcgtacagggactgtatgctgctgggatgcctgaacagtggtaccagttttgtgtctggcttcgcaattttttccatcctgggcttcatggcacaagagcaaggggtggacattgctgatgtggctgagtcaggtcctggcctggccttcattgcctacccaaaagctgtgacaatgatgccgctgcccacattttggtccattcttttttttattatgcttctcttgcttggactggatagccagtttgttgaagttgaaggacagatcacatccttggttgatctttacccatccttcctaaggaagggttatcgtcgggaaatcttcatcgccttcgtgtgtagcatcagctacctgctggggctgacgatggtgacggagggtggcatgtatgtgtttcagctctttgactactatgcagctagcggtgtatgccttttgtgggttgcattctttgaatgttttgttattgcctggatatatggaggtgataacctttatgatggtattgaggacatgattggctatcggcccgggccctggatgaagtacagctgggctgtgatcactccagttctctgtgttggatgtttcatcttctcgctcgtcaagtacgtacccctgacctacaacaaaacatacgtgtaccccaactgggccattgggctgggctggagcctggccctttcctccatgctctgcgttcccttggtcatcgtcatccgcctctgccagactgaggggccgttccttgtgagagtcaagtacctgctgaccccaagggaacccaaccgctgggctgtggagcgcgagggagccacaccttacaactctcgcaccgtcatgaacggcgctctcgtgaaaccgacccacatcattgtggagaccatgatgtgagctctctcgggtcgacggggccggcggctttcctgctgtttactaacattagattctcataggaccaggtttacagagctttatatttgcactaggatttttttttttttgtaattgtcacagaaaatgtaattgtgggtatgtgtgcgtgcgtgtgtgtgtgtgtgtgtatcgtgtgtgtgtgttttgttttgatttgggggatattttgtacaaaaagaaaacccacgggaagatgtccgtggagaggcagagctttcatactgaattagatgtattttatgggaatttggtaaatttttctttgtatttttttttttacatataagtatatatacacttagagattgtcatatacttttaccacttgaattgatcttcttgccagcaatagatctcattttcaaaagcaattcttcggtgctgtgtagctggcagaaagttctgtccagtaaacgcaggatggaattttcctgggactctacacccatcttaaggtggtataccttccaaatcctggttcagatggaagaaatagcaggagagaggacccattagctggcagacccagggggaagaaaggagggctgtgaggagatacctcattaaacttggcttagtgaagaagagagatgccaaaggaatgaaccaacccttcacataaaggagactggctgaagctgaatgaggaggccctatagcagaagtctgattctaagagcagtagaaacttgtaccagaagcaaaatcccacttttaattttgagatggtgagtggatagtcagtagaccgtcagaaccactggccagagagggagctgctagagatccaagaaggctggcaggagtgaggctcacaactcagcctcgcaagaggtggcagaggcacaggaggccacagtccttcctggggcattccaggcagagaaggagcagaggctctcccggcaggagctggggtctcagggctcagatgagtctgttgcatttgaatggggtcatagcaggttctggtcattccccaagcaacatctcagcatctcttaaagttgcctgcaggaatgaagcatgacatacctgttgagggactaggggagtggtggggaggtgagtggaccaaaggatataggccccaggcatgcagatgggcccggtgtcggggaggggtgctttctttcctcatctccccactccccactctcagcctgggagactcctgccaagccctcattaaagatgccaccctgggctgccctggcacctagcaaggcacaccaagaacagcttttgagtctgtatcctccactgggggaagtgctcccagttcagaacaagggcagcccgtggtgctgacctaggatataacaaagctcttcacttcaaaacccctgcaatagctgggtttacagacatttaccacctgcggacccaaaagagaaggcctaggagagttttctagaaggttgggattgtcagggtcctggcccctcagaactggcttgatcaagggccttatgtggagcagaggttgtctctgaaccaggagagaaggtactatacctttcaaatccccagggcagacacacccccacccagcccctatttggacctaaactgtgccatttgaacagtcacttccaagctcagtctaaatgaaaccgaaacgtgaccacgcacaaaggcagtcactgcctcgaggggtgcagaccgcagaattttcacagcaggggctcttggaaccctggaaacccccttcttaaatttgggaggaggagtatgcctttggtgtccccctcccaaggggcaattctgaaccccatctttggcaggcatacatatttcactgtttccaaagctatctactctgccaaacaacacccagtcctattccaaactctcaacgattctatcttgttcctgtttttctatgtatttatggttgccgtttgtgtctgatttgattttactgttttttccctgattttatggagtagcattgtgacctgttttcctttgtcttatataactttagtaaactaaccactgtcaatgattgagggcaggtggcacgtggggaagaggggacttggcacgcagtggctacctgggcatttgtggtcatttcagtttccatctccccagcgggggctccctgggtgaaaggccacagtattttgggttggtaggcaaattgcaacattctggacatggcctgaggaaggcctcttcttataagattctcagaccaaattctagaccaaagacacaggcagaccaagtccccaggccccgcctggaaggaagtcgttcctcaactctccccaaggcacctgtctccaatcagagccctctcgcccagccagccctggctctgtgtgcagagcatagctctgcgagtacctgtgtaataatgctcaaccttcatgtctccgtataaacgaaactttccatgagagctcatgactctggtccacctgtctatagagaatgggcaaagtccttcacctgctttctgcttgggatgggtcagaaatgctgatgcccgcacatagcccagccagccagatctggaaaggaagcgagggggttgtttaaatcaattttttaagatgaagaagtgggagacactgcgttgagatgggccatgctagggccacagagatttcctgacggtcagggagagaagggcctccagggtcccctaacccaacgcccttgttgtaaatgaggtaactgaggctcagggaggcactgtgagccaggaatggattttcttgaaacagctctagctgcaggttctccgaggtaggtgcagggaatggtgagtgtctaaccagggctacatccagcaacatcctcaaggtcttcctgacaaccaaagacaagcctttatggaaaaggaaatgcgctcccctccatgttcagggatgaggggagcagcagcagccacactcccaccatcctcacagaattcctggacccatgcggtggctccgtgagctgggtgactccagcctcacctgcacaccccagccctgcacggggccctccttcctcccagcagcccttggtgagctaggaattgagatccctgtttgtgaaagagggaactgaggtgcagagaagccagaggtgtgccagatccttaggcaggatttagatgaagtcgccctggctccagactgaccccgaggctctgcggggagtttccaggcagcaggaagtggccttggatgctctccttccaggacagcataacccctgggccatgtgcagctccttcactgccccctggatccccagcatacccccaaagacagtggggaaacacaaggggagagcacagcatggcccctccagcccacttcagggcactcttgtatcacccgggtaccgccacactggtcccccacccagccagcatctcccagcacagcccctctccctggggaaatgctctgggtagccagtctaaaggcagaggcacctaactgctccccgcagcccaccccacccaagattcagacacaagccaggaaaggacccaagagaaaatccttcaaggtggcctgaggtcccatccctccctcagacccatgtggtcccaggccaggctgcctgggacacggtaaataccactgtgtgcaaaaatcgaagtacaaaaccacaagactaaacaaaacaaacccagagagccaaacttgtagaggtgggcagtccagaaagcagggggcagccctccccctttccttctctccctgatcctcagaatatatattgttgtaataggaagcatttttgcattgttctcttgtgggtgtcactacagacatgttctggcgtgttctccgagggatggagcatcctgttatatatttgacttcaaattgagatgttggcttcattttttttttttacccaattaatctcccaatccctagcaactgtgactctgtatttagcacaagagaaagctgagaatgtgggtcttgcctccttccagaaatatgtctggctcatcaggacatttttttaaaacttcaaaatatttttaagatattttaaacttttataaaaaaaaaatcaaccaacaagagacttttctgaggaggaacatttgtatttgaacaagatccttggtgtgtagttcagtcttgcagtatacaagcttttgtgtataaatgttttatgatatgattccctgtattttgcaggggtttttttctcttttgctttttagataaatatgtatatcaatattttaaattcatctttgctttttttagaggagtttgtaatcaccttataacatgaaaataaacatttcctttttaacatcc

SEQ ID NO: 29337 - DNA, 1260 bp, Homo sapiens
cagacaacagacacgcgaggtcaggaagaagccgcttataaattaccgcttccttcgcgccgccgccaacgccgagccccgaggaccgcaagcccagaggacaagctgcgccaagagggagtgctggagctgttcacccagcgggtcagagagcgagccgggcaggccagcccccggccggcggaaccctggcacagcctgagcagatgctgcgggcggcgccgcagccaccccagatccagaaccagaaccacagcccttctgaggagctcccaaacaaagcaaggagatggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgcgtttctcataccgtattttattttcctgtttgggagcggcctgcctgtgtttttcttggagatcatcataggccagtacacctctgaagggggcatcacctgctgggaaaagatctgccccttgttctctggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagtaaggccacctcattgaagcaaggaggaggacatgggtggggcagagaggatggcccacttccttatctcctcccctgggatacaggagccactgtcttcgggggagtgggaggagggtgcagatctggagataaatttatgcctttggccatagacaggactggaatcccagttctgccacttactggctgtttgaccttaggcaagccactcctcctttctgagcctcagtttctttacctgtaagataaaaagaatgaatcattactaccctgtgaggcaggtatgcatacttatgttgtctaaaaatgatacagttttcttaatgtattttaggaaaaaatatattctgttattgcacagagaaaaa

SEQ ID NO: 29338 - DNA, 1991 bp, Homo sapiens
atttttccacccagcaggatgggtgatgctgagagctgcctgctcagacaacagacacgcgaggtcaggaagaagccgcttataaattaccgcttccttcgcgccgccgccaacgccgagccccgaggaccgcaagcccagaggacaagctgcgccaagagggagtgctggagctgttcacccagcgggtcagagagcgagccgggcaggccagcccccggccggcggaaccctggcacagcctgagcagatgctgcgggcggcgccgcagccaccccagatccagaaccagaaccacagcccttctgaggagctcccaaacaaagcaaggagatggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgcgtttctcataccgtattttattttcctgtttgggagcggcctgcctgtgtttttcttggagatcatcataggccagtacacctctgaagggggcatcacctgctgggaaaagatctgccccttgttctctggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagcgcaacgtgctgagcttgtcccctggaatcgaccacccaggctctctgaaatgggacctcgctctctgccttcttttagtctggctagtgtgtttcttctgcatctggaagggcgtcaggtccactgggaaggtcgtctacttcacagccacttttccattcgccatgctcctggtgctgctggtccgagggctgacgctgccgggcgcgggcgcaggcatcaagttctatctgtatcctgacatcacccgccttgaggacccacaggtgtggattgacgctgggactcagatattcttctcttatgccatctgcctgggggctatgacctcgctggggagctacaacaagtacaagtataactcgtacaggtcctggcctggccttcattgcctacccaaaagctgtgacaatgatgccgctgcccacattttggtccattcttttttttattatgcttctcttgcttggactggatagccagtttgttgaagttgaaggacagatcacatccttggttgatctttacccatccttcctaaggaagggttatcgtcgggaaatcttcatcgccttcgtgtgtagcatcagctacctgctggggctgacgatggtgacggagggtggcatgtatgtgtttcagctctttgactactatgcagctagcggtgtatgccttttgtgggttgcattctttgaatgttttgttattgcctggatatatggtgagtacagattttttcatgtcctttctcaaggctctcctttgggcttctctacttagaagcttcagaagcagagaatactaacagaaattcaatttgagttgaacagtaggccctccctacctagactacacaaataatctcactgtagccacactgaagatcctcctggtgctaaaggtgtgaggtgtgactggatgttttcacagtttcagaacttggttgtgcaggacctggaatactccttttttatctccttgaggccttgggtttgagtttgggctgtgcctaagattgcacacctagggtttggagtgtgcctcagattgccag

SEQ ID NO: 29339 - DNA, 458 bp, Homo sapiens
aagtccaacagtgcgcgactccccaggtcaggagaagccccgatgtgtgcagaatctgcagatggggctgctctcggccctgcctctggctgtggaaacaggcctccaagtacccaagaaagcaaggagatggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgcgtttctcataccgtattttattttcctgtttgggagcggcctgcctgtgtttttcttggagatcatcataggccagtacacctctgaagggggcat

SEQ ID NO: 29340 - DNA, 6534 bp, Homo sapiens
atttttccacccagcaggatgggtgatgctgagagctgcctgctcagacaacagacacgcgaggtcaggaagaagccgcttataaattaccgcttccttcgcgccgccgccaacgccgagccccgaggaccgcaagcccagaggacaagctgcgccaagagggagtgctggagctgttcacccagcgggtcagagagcgagccgggcaggccagcccccggccggcggaaccctggcacagcctgagcagatgctgcgggcggcgccgcagccaccccagatccagaaccagaaccacagcccttctgaggagctcccaaaccaaggagatggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgcgtttctcataccgtattttattttcctgtttgggagcggcctgcctgtgtttttcttggagatcatcataggccagtacacctctgaagggggcatcacctgctgggaaaagatctgccccttgttctctggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagcgcaacgtgctgagcttgtcccctggaatcgaccacccaggctctctgaaatgggacctcgctctctgccttcttttagtctggctagtgtgtttcttctgcatctggaagggcgtcaggtccactgggaaggtcgtctacttcacagccacttttccattcgccatgctcctggtgctgctggtccgagggctgacgctgccgggcgcgggcgcaggcatcaagttctatctgtatcctgacatcacccgccttgaggacccacaggtgtggattgacgctgggactcagatattcttctcttatgccatctgcctgggggctatgacctcgctggggagctacaacaagtacaagtataactcgtacagggactgtatgctgctgggatgcctgaacagtggtaccagttttgtgtctggcttcgcaattttttccatcctgggcttcatggcacaagagcaaggggtggacattgctgatgtggctgagtcaggtcctggcctggccttcattgcctacccaaaagctgtgacaatgatgccgctgcccacattttggtccattcttttttttattatgcttctcttgcttggactggatagccagtttgttgaagttgaaggacagatcacatccttggttgatctttacccatccttcctaaggaagggttatcgtcgggaaatcttcatcgccttcgtgtgtagcatcagctacctgctggggctgacgatggtgacggagggtggcatgtatgtgtttcagctctttgactactatgcagctagcggtgtatgccttttgtgggttgcattctttgaatgttttgttattgcctggatatatggaggtgataacctttatgatggtattgaggacatgattggctatcggcccgggccctggatgaagtacagctgggctgtgatcactccagttctctgtgttggatgtttcatcttctcgctcgtcaagtacgtacccctgacctacaacaaaacatacgtgtaccccaactgggccattgggctgggctggagcctggccctttcctccatgctctgcgttcccttggtcatcgtcatccgcctctgccagactgaggggccgttccttgtgagagtcaagtacctgctgaccccaagggaacccaaccgctgggctgtggagcgcgagggagccacaccttacaactctcgcaccgtcatgaacggcgctctcgtgaaaccgacccacatcattgtggagaccatgatgtgagctctctcgggtcgacggggccggcggctttcctgctgtttactaacattagattctcataggaccaggtttacagagctttatatttgcactaggatttttttttttttgtaattgtcacagaaaatgtaattgtgggtatgtgtgcgtgcgtgtgtgtgtgtgtgtgtatcgtgtgtgtgtgttttgttttgatttgggggatattttgtacaaaaagaaaacccacgggaagatgtccgtggagaggcagagctttcatactgaattagatgtattttatgggaatttggtaaatttttctttgtatttttttttttacatataagtatatatacacttagagattgtcatatacttttaccacttgaattgatcttcttgccagcaatagatctcattttcaaaagcaattcttcggtgctgtgtagctggcagaaagttctgtccagtaaacgcaggatggaattttcctgggactctacacccatcttaaggtggtataccttccaaatcctggttcagatggaagaaatagcaggagagaggacccattagctggcagacccagggggaagaaaggagggctgtgaggagatacctcattaaacttggcttagtgaagaagagagatgccaaaggaatgaaccaacccttcacataaaggagactggctgaagctgaatgaggaggccctatagcagaagtctgattctaagagcagtagaaacttgtaccagaagcaaaatcccacttttaattttgagatggtgagtggatagtcagtagaccgtcagaaccactggccagagagggagctgctagagatccaagaaggctggcaggagtgaggctcacaactcagcctcgcaagaggtggcagaggcacaggaggccacagtccttcctggggcattccaggcagagaaggagcagaggctctcccggcaggagctggggtctcagggctcagatgagtctgttgcatttgaatggggtcatagcaggttctggtcattccccaagcaacatctcagcatctcttaaagttgcctgcaggaatgaagcatgacatacctgttgagggactaggggagtggtggggaggtgagtggaccaaaggatataggccccaggcatgcagatgggcccggtgtcggggaggggtgctttctttcctcatctccccactccccactctcagcctgggagactcctgccaagccctcattaaagatgccaccctgggctgccctggcacctagcaaggcacaccaagaacagcttttgagtctgtatcctccactgggggaagtgctcccagttcagaacaagggcagcccgtggtgctgacctaggatataacaaagctcttcacttcaaaacccctgcaatagctgggtttacagacatttaccacctgcggacccaaaagagaaggcctaggagagttttctagaaggttgggattgtcagggtcctggcccctcagaactggcttgatcaagggccttatgtggagcagaggttgtctctgaaccaggagagaaggtactatacctttcaaatccccagggcagacacacccccacccagcccctatttggacctaaactgtgccatttgaacagtcacttccaagctcagtctaaatgaaaccgaaacgtgaccacgcacaaaggcagtcactgcctcgaggggtgcagaccgcagaattttcacagcaggggctcttggaaccctggaaacccccttcttaaatttgggaggaggagtatgcctttggtgtccccctcccaaggggcaattctgaaccccatctttggcaggcatacatatttcactgtttccaaagctatctactctgccaaacaacacccagtcctattccaaactctcaacgattctatcttgttcctgtttttctatgtatttatggttgccgtttgtgtctgatttgattttactgttttttccctgattttatggagtagcattgtgacctgttttcctttgtcttatataactttagtaaactaaccactgtcaatgattgagggcaggtggcacgtggggaagaggggacttggcacgcagtggctacctgggcatttgtggtcatttcagtttccatctccccagcgggggctccctgggtgaaaggccacagtattttgggttggtaggcaaattgcaacattctggacatggcctgaggaaggcctcttcttataagattctcagaccaaattctagaccaaagacacaggcagaccaagtccccaggccccgcctggaaggaagtcgttcctcaactctccccaaggcacctgtctccaatcagagccctctcgcccagccagccctggctctgtgtgcagagcatagctctgcgagtacctgtgtaataatgctcaaccttcatgtctccgtataaacgaaactttccatgagagctcatgactctggtccacctgtctatagagaatgggcaaagtccttcacctgctttctgcttgggatgggtcagaaatgctgatgcccgcacatagcccagccagccagatctggaaaggaagcgagggggttgtttaaatcaattttttaagatgaagaagtgggagacactgcgttgagatgggccatgctagggccacagagatttcctgacggtcagggagagaagggcctccagggtcccctaacccaacgcccttgttgtaaatgaggtaactgaggctcagggaggcactgtgagccaggaatggattttcttgaaacagctctagctgcaggttctccgaggtaggtgcagggaatggtgagtgtctaaccagggctacatccagcaacatcctcaaggtcttcctgacaaccaaagacaagcctttatggaaaaggaaatgcgctcccctccatgttcagggatgaggggagcagcagcagccacactcccaccatcctcacagaattcctggacccatgcggtggctccgtgagctgggtgactccagcctcacctgcacaccccagccctgcacggggccctccttcctcccagcagcccttggtgagctaggaattgagatccctgtttgtgaaagagggaactgaggtgcagagaagccagaggtgtgccagatccttaggcaggatttagatgaagtcgccctggctccagactgaccccgaggctctgcggggagtttccaggcagcaggaagtggccttggatgctctccttccaggacagcataacccctgggccatgtgcagctccttcactgccccctggatccccagcatacccccaaagacagtggggaaacacaaggggagagcacagcatggcccctccagcccacttcagggcactcttgtatcacccgggtaccgccacactggtcccccacccagccagcatctcccagcacagcccctctccctggggaaatgctctgggtagccagtctaaaggcagaggcacctaactgctccccgcagcccaccccacccaagattcagacacaagccaggaaaggacccaagagaaaatccttcaaggtggcctgaggtcccatccctccctcagacccatgtggtcccaggccaggctgcctgggacacggtaaataccactgtgtgcaaaaatcgaagtacaaaaccacaagactaaacaaaacaaacccagagagccaaacttgtagaggtgggcagtccagaaagcagggggcagccctccccctttccttctctccctgatcctcagaatatatattgttgtaataggaagcatttttgcattgttctcttgtgggtgtcactacagacatgttctggcgtgttctccgagggatggagcatcctgttatatatttgacttcaaattgagatgttggcttcattttttttttttacccaattaatctcccaatccctagcaactgtgactctgtatttagcacaagagaaagctgagaatgtgggtcttgcctccttccagaaatatgtctggctcatcaggacatttttttaaaacttcaaaatatttttaagatattttaaacttttataaaaaaaaaatcaaccaacaagagacttttctgaggaggaacatttgtatttgaacaagatccttggtgtgtagttcagtcttgcagtatacaagcttttgtgtataaatgttttatgatatgattccctgtattttgcaggggtttttttctcttttgctttttagataaatatgtatatcaatattttaaattcatctttgctttttttagaggagtttgtaatcaccttataacatgaaaataaacatttcctttttaacatccaa

SEQ ID NO: 29341 - DNA, 6409 bp, Homo sapiens
atttttccacccagcaggatgggtgatgctgagagctgcctgctcagacaacagacacgcgaggtcaggaagaagccgcttataaattaccgcttccttcgcgccgccgccaacgccgagccccgaggaccgcaagcccagaggacaagctgcgccaagagggagtgctggagctgttcacccagcgggtcagagagcgagccgggcaggccagcccccggccggcggaaccctggcacagcctgagcagatgctgcgggcggcgccgcagccaccccagatccagaaccagaaccacagcccttctgaggagctcccaaaccaaggagatggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgcgtttctcataccgtattttattttcctgtttgggagcggcctgcctgtgtttttcttggagatcatcataggccagtacacctctgaagggggcatcacctgctgggaaaagatctgccccttgttctctggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagcgcaacgtgctgagcttgtcccctggaatcgaccacccaggctctctgaaatgggacctcgctctctgccttcttttagtctggctagtgtgtttcttctgcatctggaagggcgtcaggtccactgggaaggtcgtctacttcacagccacttttccattcgccatgctcctggtgctgctggtccgagggctgacgctgccgggcgcgggcgcaggcatcaagttctatctgtatcctgacatcacccgccttgaggacccacaggtgtggattgacgctgggactcagatattcttctcttatgccatctgcctgggggctatgacctcgctggggagctacaacaagtacaagtataactcgtacaggtcctggcctggccttcattgcctacccaaaagctgtgacaatgatgccgctgcccacattttggtccattcttttttttattatgcttctcttgcttggactggatagccagtttgttgaagttgaaggacagatcacatccttggttgatctttacccatccttcctaaggaagggttatcgtcgggaaatcttcatcgccttcgtgtgtagcatcagctacctgctggggctgacgatggtgacggagggtggcatgtatgtgtttcagctctttgactactatgcagctagcggtgtatgccttttgtgggttgcattctttgaatgttttgttattgcctggatatatggaggtgataacctttatgatggtattgaggacatgattggctatcggcccgggccctggatgaagtacagctgggctgtgatcactccagttctctgtgttggatgtttcatcttctcgctcgtcaagtacgtacccctgacctacaacaaaacatacgtgtaccccaactgggccattgggctgggctggagcctggccctttcctccatgctctgcgttcccttggtcatcgtcatccgcctctgccagactgaggggccgttccttgtgagagtcaagtacctgctgaccccaagggaacccaaccgctgggctgtggagcgcgagggagccacaccttacaactctcgcaccgtcatgaacggcgctctcgtgaaaccgacccacatcattgtggagaccatgatgtgagctctctcgggtcgacggggccggcggctttcctgctgtttactaacattagattctcataggaccaggtttacagagctttatatttgcactaggatttttttttttttgtaattgtcacagaaaatgtaattgtgggtatgtgtgcgtgcgtgtgtgtgtgtgtgtgtatcgtgtgtgtgtgttttgttttgatttgggggatattttgtacaaaaagaaaacccacgggaagatgtccgtggagaggcagagctttcatactgaattagatgtattttatgggaatttggtaaatttttctttgtatttttttttttacatataagtatatatacacttagagattgtcatatacttttaccacttgaattgatcttcttgccagcaatagatctcattttcaaaagcaattcttcggtgctgtgtagctggcagaaagttctgtccagtaaacgcaggatggaattttcctgggactctacacccatcttaaggtggtataccttccaaatcctggttcagatggaagaaatagcaggagagaggacccattagctggcagacccagggggaagaaaggagggctgtgaggagatacctcattaaacttggcttagtgaagaagagagatgccaaaggaatgaaccaacccttcacataaaggagactggctgaagctgaatgaggaggccctatagcagaagtctgattctaagagcagtagaaacttgtaccagaagcaaaatcccacttttaattttgagatggtgagtggatagtcagtagaccgtcagaaccactggccagagagggagctgctagagatccaagaaggctggcaggagtgaggctcacaactcagcctcgcaagaggtggcagaggcacaggaggccacagtccttcctggggcattccaggcagagaaggagcagaggctctcccggcaggagctggggtctcagggctcagatgagtctgttgcatttgaatggggtcatagcaggttctggtcattccccaagcaacatctcagcatctcttaaagttgcctgcaggaatgaagcatgacatacctgttgagggactaggggagtggtggggaggtgagtggaccaaaggatataggccccaggcatgcagatgggcccggtgtcggggaggggtgctttctttcctcatctccccactccccactctcagcctgggagactcctgccaagccctcattaaagatgccaccctgggctgccctggcacctagcaaggcacaccaagaacagcttttgagtctgtatcctccactgggggaagtgctcccagttcagaacaagggcagcccgtggtgctgacctaggatataacaaagctcttcacttcaaaacccctgcaatagctgggtttacagacatttaccacctgcggacccaaaagagaaggcctaggagagttttctagaaggttgggattgtcagggtcctggcccctcagaactggcttgatcaagggccttatgtggagcagaggttgtctctgaaccaggagagaaggtactatacctttcaaatccccagggcagacacacccccacccagcccctatttggacctaaactgtgccatttgaacagtcacttccaagctcagtctaaatgaaaccgaaacgtgaccacgcacaaaggcagtcactgcctcgaggggtgcagaccgcagaattttcacagcaggggctcttggaaccctggaaacccccttcttaaatttgggaggaggagtatgcctttggtgtccccctcccaaggggcaattctgaaccccatctttggcaggcatacatatttcactgtttccaaagctatctactctgccaaacaacacccagtcctattccaaactctcaacgattctatcttgttcctgtttttctatgtatttatggttgccgtttgtgtctgatttgattttactgttttttccctgattttatggagtagcattgtgacctgttttcctttgtcttatataactttagtaaactaaccactgtcaatgattgagggcaggtggcacgtggggaagaggggacttggcacgcagtggctacctgggcatttgtggtcatttcagtttccatctccccagcgggggctccctgggtgaaaggccacagtattttgggttggtaggcaaattgcaacattctggacatggcctgaggaaggcctcttcttataagattctcagaccaaattctagaccaaagacacaggcagaccaagtccccaggccccgcctggaaggaagtcgttcctcaactctccccaaggcacctgtctccaatcagagccctctcgcccagccagccctggctctgtgtgcagagcatagctctgcgagtacctgtgtaataatgctcaaccttcatgtctccgtataaacgaaactttccatgagagctcatgactctggtccacctgtctatagagaatgggcaaagtccttcacctgctttctgcttgggatgggtcagaaatgctgatgcccgcacatagcccagccagccagatctggaaaggaagcgagggggttgtttaaatcaattttttaagatgaagaagtgggagacactgcgttgagatgggccatgctagggccacagagatttcctgacggtcagggagagaagggcctccagggtcccctaacccaacgcccttgttgtaaatgaggtaactgaggctcagggaggcactgtgagccaggaatggattttcttgaaacagctctagctgcaggttctccgaggtaggtgcagggaatggtgagtgtctaaccagggctacatccagcaacatcctcaaggtcttcctgacaaccaaagacaagcctttatggaaaaggaaatgcgctcccctccatgttcagggatgaggggagcagcagcagccacactcccaccatcctcacagaattcctggacccatgcggtggctccgtgagctgggtgactccagcctcacctgcacaccccagccctgcacggggccctccttcctcccagcagcccttggtgagctaggaattgagatccctgtttgtgaaagagggaactgaggtgcagagaagccagaggtgtgccagatccttaggcaggatttagatgaagtcgccctggctccagactgaccccgaggctctgcggggagtttccaggcagcaggaagtggccttggatgctctccttccaggacagcataacccctgggccatgtgcagctccttcactgccccctggatccccagcatacccccaaagacagtggggaaacacaaggggagagcacagcatggcccctccagcccacttcagggcactcttgtatcacccgggtaccgccacactggtcccccacccagccagcatctcccagcacagcccctctccctggggaaatgctctgggtagccagtctaaaggcagaggcacctaactgctccccgcagcccaccccacccaagattcagacacaagccaggaaaggacccaagagaaaatccttcaaggtggcctgaggtcccatccctccctcagacccatgtggtcccaggccaggctgcctgggacacggtaaataccactgtgtgcaaaaatcgaagtacaaaaccacaagactaaacaaaacaaacccagagagccaaacttgtagaggtgggcagtccagaaagcagggggcagccctccccctttccttctctccctgatcctcagaatatatattgttgtaataggaagcatttttgcattgttctcttgtgggtgtcactacagacatgttctggcgtgttctccgagggatggagcatcctgttatatatttgacttcaaattgagatgttggcttcattttttttttttacccaattaatctcccaatccctagcaactgtgactctgtatttagcacaagagaaagctgagaatgtgggtcttgcctccttccagaaatatgtctggctcatcaggacatttttttaaaacttcaaaatatttttaagatattttaaacttttataaaaaaaaaatcaaccaacaagagacttttctgaggaggaacatttgtatttgaacaagatccttggtgtgtagttcagtcttgcagtatacaagcttttgtgtataaatgttttatgatatgattccctgtattttgcaggggtttttttctcttttgctttttagataaatatgtatatcaatattttaaattcatctttgctttttttagaggagtttgtaatcaccttataacatgaaaataaacatttcctttttaacatccaa

SEQ ID NO: 29342 - DNA, 5174 bp, Homo sapiens
actcgccctccagcttctgccctgcctgctgtgtgcggagccgtccagcgaccaccatggtgaggctcgtgctgcccaaccccggcctagacgcccggatcccgtccctggctgagctggagaccatcgagcaggaggaggccagctcccggccgaagtgggacaacaaggcgcagtacatgctcacctgcctgggcttctgcgtgggcctcggcaacgtgtggcgcttcccctacctgtgtcagagccacggaggaggagccttcatgatcccgttcctcatcctgctggtcctggagggcatccccctgctgtacctggagttcgccatcgggcagcggctgcggcggggcagcctgggtgtgtggagctccatccacccggccctgaagggcctaggcctggcctccatgctcacgtccttcatggtgggactgtattacaacaccatcatctcctggatcatgtggtacttattcaactccttccaggagcctctgccctggagcgactgcccgctcaacgagaaccagacagggtatgtggacgagtgcgccaggagctcccctgtggactacttctggtaccgagagacgctcaacatctccacgtccatcagcgactcgggctccatccagtggtggatgctgctgtgcctggcctgcgcatggagcgtcctgtacatgtgcaccatccgcggcatcgagaccaccgggaaggccgtgtacatcacctccacgctgccctatgtcgtcctgaccatcttcctcatccgaggcctgacgctgaagggcgccaccaatggcatcgtcttcctcttcacgcccaacgtcacggagctggcccagccggacacctggctggacgcgggcgcacaggtcttcttctccttctccctggccttcgggggcctcatctccttctccagctacaactctgtgcacaacaactgcgagaaggactcggtgattgtgtccatcatcaacggcttcacatcggtgtatgtggccatcgtggtctactccgtcattgggttccgcgccacacagcgctacgacgactgcttcagcacgaacatcctgaccctcatcaacgggttcgacctgcctgaaggcaacgtgacccaggagaactttgtggacatgcagcagcggtgcaacgcctccgaccccgcggcctacgcgcagctggtgttccagacctgcgacatcaacgccttcctctcagaggccgtggagggcacaggcctggccttcatcgtcttcaccgaggccatcaccaagatgccgttgtccccactgtggtctgtgctcttcttcattatgctcttctgcctggggctgtcatctatgtttgggaacatggagggcgtcgttgtgcccctgcaggacctcagagtcatccccccgaagtggcccaaggaggtgctcacaggcctcatctgcctggggacattcctcattggcttcatcttcacgctgaactccggccagtactggctctccctgctggacagctatgccggctccattcccctgctcatcatcgccttctgcgagatgttctctgtggtctacgtgtacggtgtggacaggttcaataaggacatcgagttcatgatcggccacaagcccaacatcttctggcaagtcacgtggcgcgtggtcagccccctgctcatgctgatcatcttcctcttcttcttcgtggtagaggtcagtcaggagctgacctacagcatctgggaccctggctacgaggaatttcccaaatcccagaagatctcctacccgaactgggtgtatgtggtggtggtgattgtggctggagtgccctccctcaccatccctggctatgccatctacaagctcatcaggaaccactgccagaagccaggggaccatcaggggctggtgagcacactgtccacagcctccatgaacggggacctgaagtactgagaaggcccatcccacggcgtgccatacactggtgtcagggaaggaggaaccagcaagacctgtggggtgggggccgggctgcacctgcatgtgtgtaagcgtgagtgtatgctcgtgtgtgagtgtgtgtattgtacacgcatgtgccatgtgtgcagatatgtatcgtgtgtgcatgtacatgcatgggcactgtgtgagtgtgcacgtgtatgcacacatatacatgtgtgtgggtgtgtgtattgtatgtgcatgtgccatgtgtgcagatgtgtcatgttgtgtgtgtgcatgtacatgtatggacattgtgtgagtgtgcaagtgtgcatgcatatacatgtgtgcgatatttgctgcccgtgtgtgtgcatgtatatatagacatacatgcctatgttgtgtgtggtgtgcatatgtgtgaacacacacgtgtatacatgcatgcacatgtgctcgtacaatgggtgtccacatgcacgtgtatatgtatatctgtgagtgtatatacatgcatgcaattgtgtgtatgtgtgttctgtgtgtgcgtttgcaagtatatatgcacatgtgtatatgtacatgtatgcctgtgtgacgtgtgtatatgtgagcatgtgtacgtgtgtgtatacgtgtgttgtgtatatgtgtgtgtctgtacctgtttgtgtatatgtgtgtgatgtgtgctcgtgtgtgtgcatattcaggcaggtgtgcatttgtgcatgccagtgtgtatgtatgtgcgcatatggacacgcatggacacgcatatggacacatatggacacacatatggacacgtgtggatatgtgtgcgtacacgtcgctgggacacatgcctgccactcggggcccagctgccctctgtgtttgtccttgccacagtcacggggtgcatgtgcagaggggagcagaccactggggacgtgctgtgccctgcacgtgcccgggggaagcggaagctgcagctggggtgggggcagcacctctatgcttcatctctgtgggtggcaggagacaaaagcacagggtactatcttggctcctgggagcgactcttgctacccacccccacccatccccttccccttggtgttgacctttgacctgggggttcccagagccctgtagccctcgacccggagcagcctctcggaagccggagtgggcagttgctggcgattctgagaaaacttggccgcatccaccggggccctgcctccagtcggccgctgccgagtctctgcgttctggccgcttcccggcttaatgaatgccagccatttaatcattgctcctgccaccacaaatagatgagcagttaaataaaactcaacttggcataattcaaggcaaataccactctgtgcattttcttaagaggacatgagctgtgtgaatttttagccagcctttggaaaagatgggttacagggtaactcaaccctggctgccatccttgggcactgtgtgtgtccagggcaccttggaggaccgtgcagcccccagaagcttccagctcccgcaccactcagtgaagcccagcctggcgcctgccctgcccccgtcacgggatgggcccccattggggttcaacattccatcgcagccaaaggcagtcggcacttgggacatctgcttccacggacaggtcacctccgctttgcacggaagaatctggatgcttacattaaactggtgttctgagagttcctacggacaggtcacctccgctttgcatggaagaatctggatgcttacattaaactggtgttctgagagttcctacggacaggtcacctctgctttccatagaagaatctggacgcttacattaaactgatgttctgagaattcctacaggcaggactgaaagcctggtgtgtgccagtatgatgttccacccacagaaacctggtcacaatcgtcccttccagcaccccatccagcagtgactgcacacactgagtcccctaccagcccctttcaccctgctgactgtcactgggccctgggatgcgcaagactccacagcagcagaggtggggggacatatcacagcctctgcccccggctgtgatgccaccgaggggctcgcctgctgatggcttcaacagggtctcacctcatcttttcctgctctttggccctggatcgagaaaatttccatcagtgccccattaatatgctgccctgtggcatctgcccaggaggccctgccaggcgtgcacaggtgtgcattggtgtaccctggcatgcacaggtgtgcactgatgtgccctggcatccattggtgtaccctggtgtgcctgccataggaccctgggcgggagctcccatctcatctacatctcctgattcatgcgttgtttcataggtttcaatgtctctgtaaatgtggtagaaatgcaggctttatgggcataaagtgtacatttctaaataaatcccttctattgagtatgctcaccctagaagttactgttgtccagacgtagagggatgagtgagccagtgacctcagacgggatggtggggacggcaggtccagctcctgcctcctcctggggggtctggctttgggggcttgctccgaagaggccatggcccaggcctgtggcctcacaatggggaccaaccagctcttctcatcttcttccctcacacttcctctcactcaaataagaaccttccaaaaatgtgtccacctgggcccctgccctgggactcatggatttggagttgtggccacacggttgaggggtgcagtgtccagtggaatggggcaattgcgggcctgggggcccttggcctgtccgtggcgggagcatctgcaaggaggagccccagagtccagggagcactgtggggagctccttagagctgaactcacccggcgtcaactcatcaaccctccacccatggacaggggtgcccccagcacaggagaggactcagccctctgcccccacgcacggtgggtgcctgtcaccctgtcctgcccagcggcccgagggcagcagtgggtgtgagggcagcccccggcctcccaagagcagctgagaggatccctgcgggaatccgggcttcgggtgcatgcgatctgatctgagttgtttctgacagtgacagagtgacaatctataagtatctcaagatcaaatggttaaataaaacataagaaatttaaaacgattaaaa

SEQ ID NO: 29343 - DNA, 5247 bp, Homo sapiens
actgccgtgccggacccccgagccggagccgagcgcgccgaggccggggccatggagaaagcgcggccgctgtgggccaactcgctacagttcgtgttcgcctgcatctcgtacgccgtgggcctgggcaacgtgtggcgattcccgtacctgtgccagatgtacggcggaggtagtttcctggtcccctacatcatcatgcttatcgtggagggaatgccgctcttgtacctggaactggctgtggggcagcgcatgcggcagggcagcatcggcgcctggaggaccatcagcccgtacctcagtggtgtcggggtcgccagcgtggtggtctctttcttcctctccatgtactacaacgtcatcaacgcctgggccttctggtacctcttccactccttccaggatcccctgccgtggtctgtctgcccactgaatggtaaccacacgggctacgatgaggagtgtgagaaggcgtcctccacacagtacttctggtacaggaaaaccctcaatatctcgccgtccctccaggagaacgggggtgtgcagtgggagccggcgctgtgcctcctcctggcctggctggtggtgtacctgtgcatcctgcgtggcaccgagtccactggcaagatagagcagctggccaaccccaaggcctggatcaatgcagccacccagatcttcttctcacttggcctgggcttcggcagcctgatcgccttcgccagctacaatgagccatccaacaactgccagaagcacgccatcatcgtgtccctcatcaacagcttcacctccatatttgccagcattgtcaccttctccatctatggcttcaaggccaccttcaattatgaaaactgcttgaagaaggtgagtctgctgctgaccaacacttttgaccttgaagatggctttttgacagccagcaacctggagcaggtgaagggctacctcgcatctgcctacccaagcaaatacagcgagatgttcccgcaaatcaaaaactgcagcttggaatcggagctagacacggccgtccagggcactggcctggcattcatcgtctacacagaggccattaaaaacatggaggtgtcccagctgtggtcggtgctctacttcttcatgctgctgatgctgggcattgggagcatgctggggaacacagcggccatcctcacccctctgacagacagcaagatcatctccagccacctgcccaaggaggccatctcaggtctggtgtgccttgtcaactgtgccattggcatggtgttcacgatggaggctgggaactactggtttgacatattcaacgactacgcggccacactgtccctgctgctcatcgtgctggtggagacgattgccgtgtgctacgtgtacgggctgaggagatttgaaagtgaccttaaggccatgaccggccgagctgtgagctggtactggaaggtgatgtgggctggcgtaagcccactgctgattgtcagcctctttgtcttctacctgagcgactacatcctcacggggaccctgaagtatcaagcctgggacgcctcccagggccagctcgtgaccaaagattacccggcctatgcactggctgtcatcgggctgcttgtggcctcctccaccatgtgcatccccctggcggccctggggacttttgttcagcgtcgcctcaagaggggagacgcagaccccgtggcctgagatgtgggcttcccagccgctcacggttttacagatactatttacaggcggaaactcctcggctgctttttcaaatgcttaagccaggagtgctcagcccatcaacttcctgagtgtctaaagaagatgaggaaggtgtgcaggaagaaaactcccttgggagaacgcacaccctcccgtggtggctgttcctccctgtcacctgcctcctcatcatggaagggggtgggctatgaaagccggtctcaaagataactgcatccttcattccaggaaagccctagaattagggcacattgcaaactgaaatatgactataattcttatgggaccaaatttaagcaatttttgtttttggctgaagagacaccaaaatattagaggacaaatatttttagatccatttaaggagttttgaagtgcctaagatgacctatttgtcagtggtgcaaaattaattctcttcttttttgagttgtagtgaatatgcaatttctgtgttccccttccaccctttaaatcttaggatgacaagttataaagaaagaagatctttgtctgggacccccaaagggatcctttctctaaggtctctgacggtgggtccaggaccagacctctctacaaaaaattgccccaactacagtttgcaaccccaaaccacattagaagtctgtgcagacatccctccgtggtgtgtgtcttggtgcattggaaaaggagtcaggagccactgtgaggtgagaatgaaagtggatctcagctgggcacggtggctcacgcctgtaatcctagcaccttgggggtcaaggtgggtggatcacttgaggtcaggagtttgaggccagcctggccaacatggcgaaaccccatttctactaaaaatacaaaaaaattagctgggagtggtggcataggcctgtaattccagctactctggctgctgaggcacaagaatcatttgaacctaggaggtggcggttgctgtgagccaagatcatgccactccactccagtctgggcgacagagcaagactctgactcaaaaaaaaaaaaaaaaaaaagtggctctgactttcccataggcttaatattacatttggacatcgtggccaactctatcaagaccacaaataccacttacaattaattttaaattattcatctgtacatagttttctaaaatgtatataattcaaacagagcatcttgtaactgaagacacaccatatctatgatatcgcattagtccatgtggggaaaagaaagatcagattgttactgtgtctgtgtagaaaaggaagacataagaaactccattttgatctgtactaagaaaaattgtttctgctttgagatgttgttagcctataactttagccccaactctgtgctcacagaaacatgcgctgtaatgaatcaaagtttaatggatttagggctgtgcaggatgtgccttgttaacaatatgtttgcaggctgtatgcttggtagaagtcatcgccattctccattctcgattaaccagggacacaatgcacagcagaaagctgcagggacctctgcccaagaaagcctgggtattgtccaaggtttcccccccactgagacagcctgagatatggcctcatgggaagggaaagacctgactgtcccccagcccgacacctgtaaagggtcggtgctgaggaggaatagtgaaggagggaggcctctttgcagttgagataagaggaaggcttctgtctcctgcttgtccctggtaatggaatgtctcggtgtaaaaagctgaccattcccattcgttctattctgagataggagaaaaccgccctgtggctggaggtgagatatgctggcagcaatactgctctgttactccttgctacactgagatgtttgggtaaagagaaacataaatctagcctacgtgcacatctgggcacagtacctttccttgaacttattcgtgatacagattcctttgctcacatgtttccctgctgaccttcttcccacctgttgccctgctacactcccctcgctaagacagtaaaaataatgatcaataaatactgagggaactcagaggccagcgccggtgcgggtcctccacatgctgagcgccggtcctgggcccactgttctttctctatactttgtctctgtgtcttatttcttttctcaaaaaaatttttctttttttaactgcaataaagtaggtcgttacccctaaagtgagcgagtcccttcctgctctaacgtccagtgcttccttgagatcatggaattctggagagtttctgtggatatatttgcacagatatctttgaagacacaaacactcacctgggacgttggccggagatgtctttttatttttgtgctgtaaaattctcttacagcaaaaataggctttagaaaggtcttctactgtcttcagcaaccatctcatcttccagcttcacctgattgtccagttatcatacatttgactttcaaatgtatgaaccagcatgtaccccatggatttaatcttatctaccccgtggattcaatcttcttatcagaaggttcttttatgtcaaaaaacctgctgtcaaggcttgaagagccggcacactcaatggcaaacacagcaccgagtctgctctgaatcctggaggatctggccctcctctcaatccccactcacagtcaccgtcttacaactcagggccacctgggatcagtcatcagtcagggtgcgtaagccttgaataccaggtagcctcaggagtgaaaagataaatgtcctagatcattaccttattcagtgtccccaccttgcagcgcattccaaccacctgggagcatttaaaactccagatgcccacaccacaccctggggccacccatcagaccttctggaagcaagacctgggcctccatggccccaaaaactccctaggtgatccgatgtgcagccaaatctgagaggccccatttaaaaaagaaagaacatgggtggtacattgaggagtatttacattttataaaatgacttaaaaatttgaaggcatttttgagcatttccaattatatggaagagttacttctacggaatagtttttgctcatggaactcaaacagatgaagcaccactgttacagaataatgtgctccagatgaaaatgtctcgtttctgtgaatttcatgaagagcagaacatttctcaagaatcctcttgagccagtaatcaatcctgtctcaaaaaatgttctttgccatttcctagatactgcacaaaagtggccatgtcgacatttgtccacccaccctccaataagctggagcgacaaagggacattccatccctgtacccttagtggtagccatgacacgatggccagatcatggactccggaaagctttctgtttttactggaaacatagcaaaccttgatttagctccaagaaattgagtagggaaatatttgttttttagcaattgtcatagtaaataaaactctaagcaagtgtatctac

SEQ ID NO: 29344 - DNA, 5423 bp, Homo sapiens
gaggcgcggggccacccccaagccgagccggggtgggacggcgcgcctggcgaccgcgcactgagactgccgtgccggacccccgagccggagccgagcgcgccgaggccggggccatggagaaagcgcggccgctgtgggccaactcgctacagttcgtgttcgcctgcatctcgtacgccgtgggcctgggcaacgtgtggcgattcccgtacctgtgccagatgtacggcggaggtagtttcctggtcccctacatcatcatgcttatcgtggagggaatgccgctcttgtacctggaactggctgtggggcagcgcatgcggcagggcagcatcggcgcctggaggaccatcagcccgtacctcagtggtgtcggggtcgccagcgtggtggtctctttcttcctctccatgtactacaacgtcatcaacgcctgggccttctggtacctcttccactccttccaggatcccctgccgtggtctgtctgcccactgaatggtaaccacacgggctacgatgaggagtgtgagaaggcgtcctccacacagtacttctggtacaggaaaaccctcaatatctcgccgtccctccaggagaacgggggtgtgcagtgggagccggcgctgtgcctcctcctggcctggctggtggtgtacctgtgcatcctgcgtggcaccgagtccactggcaaggtggtgtatttcacggcgtcactgccctattgcgtgctcatcatctacctcatcaggggcctcacgctccacggagccaccaatggcctcatgtacatgttcactcccaagatagagcagctggccaaccccaaggcctggatcaatgcagccacccagatcttcttctcacttggcctgggcttcggcagcctgatcgccttcgccagctacaatgagccatccaacaactgccagaagcacgccatcatcgtgtccctcatcaacagcttcacctccatatttgccagcattgtcaccttctccatctatggcttcaaggccaccttcaattatgaaaactgcttgaagaaggtgagtctgctgctgaccaacacttttgaccttgaagatggctttttgacagccagcaacctggagcaggtgaagggctacctcgcatctgcctacccaagcaaatacagcgagatgttcccgcaaatcaaaaactgcagcttggaatcggagctagacacggccgtccagggcactggcctggcattcatcgtctacacagaggccattaaaaacatggaggtgtcccagctgtggtcggtgctctacttcttcatgctgctgatgctgggcattgggagcatgctggggaacacagcggccatcctcacccctctgacagacagcaagatcatctccagccacctgcccaaggaggccatctcaggtctggtgtgccttgtcaactgtgccattggcatggtgttcacgatggaggctgggaactactggtttgacatattcaacgactacgcggccacactgtccctgctgctcatcgtgctggtggagacgattgccgtgtgctacgtgtacgggctgaggagatttgaaagtgaccttaaggccatgaccggccgagctgtgagctggtactggaaggtgatgtgggctggcgtaagcccactgctgattgtcagcctctttgtcttctacctgagcgactacatcctcacggggaccctgaagtatcaagcctgggacgcctcccagggccagctcgtgaccaaagattacccggcctatgcactggctgtcatcgggctgcttgtggcctcctccaccatgtgcatccccctggcggccctggggacttttgttcagcgtcgcctcaagaggggagacgcagaccccgtggcctgagatgtgggcttcccagccgctcacggttttacagatactatttacaggcggaaactcctcggctgctttttcaaatgcttaagccaggagtgctcagcccatcaacttcctgagtgtctaaagaagatgaggaaggtgtgcaggaagaaaactcccttgggagaacgcacaccctcccgtggtggctgttcctccctgtcacctgcctcctcatcatggaagggggtgggctatgaaagccggtctcaaagataactgcatccttcattccaggaaagccctagaattagggcacattgcaaactgaaatatgactataattcttatgggaccaaatttaagcaatttttgtttttggctgaagagacaccaaaatattagaggacaaatatttttagatccatttaaggagttttgaagtgcctaagatgacctatttgtcagtggtgcaaaattaattctcttcttttttgagttgtagtgaatatgcaatttctgtgttccccttccaccctttaaatcttaggatgacaagttataaagaaagaagatctttgtctgggacccccaaagggatcctttctctaaggtctctgacggtgggtccaggaccagacctctctacaaaaaattgccccaactacagtttgcaaccccaaaccacattagaagtctgtgcagacatccctccgtggtgtgtgtcttggtgcattggaaaaggagtcaggagccactgtgaggtgagaatgaaagtggatctcagctgggcacggtggctcacgcctgtaatcctagcaccttgggggtcaaggtgggtggatcacttgaggtcaggagtttgaggccagcctggccaacatggcgaaaccccatttctactaaaaatacaaaaaaattagctgggagtggtggcataggcctgtaattccagctactctggctgctgaggcacaagaatcatttgaacctaggaggtggcggttgctgtgagccaagatcatgccactccactccagtctgggcgacagagcaagactctgactcaaaaaaaaaaaaaaaaaaaagtggctctgactttcccataggcttaatattacatttggacatcgtggccaactctatcaagaccacaaataccacttacaattaattttaaattattcatctgtacatagttttctaaaatgtatataattcaaacagagcatcttgtaactgaagacacaccatatctatgatatcgcattagtccatgtggggaaaagaaagatcagattgttactgtgtctgtgtagaaaaggaagacataagaaactccattttgatctgtactaagaaaaattgtttctgctttgagatgttgttagcctataactttagccccaactctgtgctcacagaaacatgcgctgtaatgaatcaaagtttaatggatttagggctgtgcaggatgtgccttgttaacaatatgtttgcaggctgtatgcttggtagaagtcatcgccattctccattctcgattaaccagggacacaatgcacagcagaaagctgcagggacctctgcccaagaaagcctgggtattgtccaaggtttcccccccactgagacagcctgagatatggcctcatgggaagggaaagacctgactgtcccccagcccgacacctgtaaagggtcggtgctgaggaggaatagtgaaggagggaggcctctttgcagttgagataagaggaaggcttctgtctcctgcttgtccctggtaatggaatgtctcggtgtaaaaagctgaccattcccattcgttctattctgagataggagaaaaccgccctgtggctggaggtgagatatgctggcagcaatactgctctgttactccttgctacactgagatgtttgggtaaagagaaacataaatctagcctacgtgcacatctgggcacagtacctttccttgaacttattcgtgatacagattcctttgctcacatgtttccctgctgaccttcttcccacctgttgccctgctacactcccctcgctaagacagtaaaaataatgatcaataaatactgagggaactcagaggccagcgccggtgcgggtcctccacatgctgagcgccggtcctgggcccactgttctttctctatactttgtctctgtgtcttatttcttttctcaaaaaaatttttctttttttaactgcaataaagtaggtcgttacccctaaagtgagcgagtcccttcctgctctaacgtccagtgcttccttgagatcatggaattctggagagtttctgtggatatatttgcacagatatctttgaagacacaaacactcacctgggacgttggccggagatgtctttttatttttgtgctgtaaaattctcttacagcaaaaataggctttagaaaggtcttctactgtcttcagcaaccatctcatcttccagcttcacctgattgtccagttatcatacatttgactttcaaatgtatgaaccagcatgtaccccatggatttaatcttatctaccccgtggattcaatcttcttatcagaaggttcttttatgtcaaaaaacctgctgtcaaggcttgaagagccggcacactcaatggcaaacacagcaccgagtctgctctgaatcctggaggatctggccctcctctcaatccccactcacagtcaccgtcttacaactcagggccacctgggatcagtcatcagtcagggtgcgtaagccttgaataccaggtagcctcaggagtgaaaagataaatgtcctagatcattaccttattcagtgtccccaccttgcagcgcattccaaccacctgggagcatttaaaactccagatgcccacaccacaccctggggccacccatcagaccttctggaagcaagacctgggcctccatggccccaaaaactccctaggtgatccgatgtgcagccaaatctgagaggccccatttaaaaaagaaagaacatgggtggtacattgaggagtatttacattttataaaatgacttaaaaatttgaaggcatttttgagcatttccaattatatggaagagttacttctacggaatagtttttgctcatggaactcaaacagatgaagcaccactgttacagaataatgtgctccagatgaaaatgtctcgtttctgtgaatttcatgaagagcagaacatttctcaagaatcctcttgagccagtaatcaatcctgtctcaaaaaatgttctttgccatttcctagatactgcacaaaagtggccatgtcgacatttgtccacccaccctccaataagctggagcgacaaagggacattccatccctgtacccttagtggtagccatgacacgatggccagatcatggactccggaaagctttctgtttttactggaaacatagcaaaccttgatttagctccaagaaattgagtagggaaatatttgttttttagcaattgtcatagtaaataaaactctaagcaagtgtatctac

SEQ ID NO: 29345 - DNA, 2662 bp, Homo sapiens
accgcgcactgagactgccgtgccggacccccgagccggagccgagcgcgccgaggccggggccatggagaaagcgcggccgctgtgggccaactcgctacagttcgtgttcgcctgcatctcgtacgccgtgggcctgggcaacgtgtggcgattcccgtacctgtgccagatgtacggcggaggtagtttcctggtcccctacatcatcatgcttatcgtggagggaatgccgctcttgtacctggaactggctgtggggcagcgcatgcggcagggcagcatcggcgcctggaggaccatcagcccgtacctcagtggtgtcggggtcgccagcgtggtggtctctttcttcctctccatgtactacaacgtcatcaacgcctgggccttctggtacctcttccactccttccaggatcccctgccgtggtctgtctgcccactgaatggtaaccacacgggctacgatgaggagtgtgagaaggcgtcctccacacagtacttctggtacaggaaaaccctcaatatctcgccgtccctccaggagaacgggggtgtgcagtgggagccggcgctgtgcctcctcctggcctggctggtggtgtacctgtgcatcctgcgtggcaccgagtccactggcaaggtggtgtatttcacggcgtcactgccctattgcgtgctcatcatctacctcatcaggggcctcacgctccacggagccaccaatggcctcatgtacatgttcactcccaagatagagcagctggccaaccccaaggcctggatcaatgcagccacccagatcttcttctcacttggcctgggcttcggcagcctgatcgccttcgccagctacaatgagccatccaacaactgccagaagcacgccatcatcgtgtccctcatcaacagcttcacctccatatttgccagcattgtcaccttctccatctatggcttcaaggccaccttcaattatgaaaactgcttgaagaaggtgagtctgctgctgaccaacacttttgaccttgaagatggctttttgacagccagcaacctggagcaggtgaagggctacctcgcatctgcctacccaagcaaatacagcgagatgttcccgcaaatcaaaaactgcagcttggaatcggagctagacacggccgtccagggcactggcctggcattcatcgtctacacagaggccattaaaaacatggaggtgtcccagctgtggtcggtgctctacttcttcatgctgctgatgctgggcattgggagcatgctggggaacacagcggccatcctcacccctctgacagacagcaagatcatctccagccacctgcccaaggaggccatctcaggtctggtgtgccttgtcaactgtgccattggcatggtgttcacgatggaggctgggaactactggtttgacatattcaacgactacgcggccacactgtccctgctgctcatcgtgctggtggagacgattgccgtgtgctacgtgtacgggctgaggagatttgaaagtgaccttaaggccatgaccggccgagctgtgagctggtactggaaggtgatgtgggctggcgtaagcccactgctgattgtcagcctctttgtcttctacctgagcgactacatcctcacggggaccctgaagtatcaagcctgggacgcctcccaggatgacaagttataaagaaagaagatctttgtctgggacccccaaagggatcctttctctaaggtctctgacggtgggtccaggaccagacctctctacaaaaaattgccccaactacagtttgcaaccccaaaccacattagaagtctgtgcagacatccctccgtggtgtgtgtcttggtgcattggaaaaggagtcaggagccactgtgagtaggtcgttacccctaaagtgagcgagtcccttcctgctctaacgtccagtgcttccttgagatcatggaattctggagagtttctgtggatatatttgcacagatatctttgaagacacaaacactcacctgggacgttggccggagatgtctttttatttttgtgctgtaaaattctcttacagcaaaaataggctttagaaaggtcttctactgtcttcagcaaccatctcatcttccagcttcacctgattgtccagttatcatacatttgactttcaaatgtatgaaccagcatgtaccccatggatttaatcttatctaccccgtggattcaatcttcttatcagaaggttcttttatgtcaaaaaacctgctgtcaaggcttgaagagccggcacactcaatggcaaacacagcaccgagtctgctctgaatcctggaggatctggccctcctctcaatccccactcacagtcaccgtcttacaactcagggccacctgggatcagtcatcagtcagggtgcgtaagccttgaataccaggtagcctcaggagtgaaaagataaatgtcctagatcattaccttattcagtgtccccaccttgcagcgcattccaaccacctgggagcatttaaaactccagatgcccacaccacaccctggggccacccatcagaccttctggaagcaagacctgggcctccatggccccaaaaactccctaggtgatccgatgtgcagccaaatct

SEQ ID NO: 29346 - DNA, 1317 bp, Homo sapiens
aatacaactgcagtggggctgcttgtggtttccaaacgtcggcagaggctggagacggctctctagtgctgggtgtggagtgaggcaccacccttgccctgaagcctggggcactcagtcaccatggctcatgccccagaaccggacccggccgcctgcgacctcggggatgagaggcccaagtgggacaacaaggcccagtacctcctgagctgcactgggtttgccgtgggactggggaacatttggcggttcccatacctgtgccagacctatggaggaggggccttcctcatcccctacgtcatcgcgctggtcttcgaggggatccccattttccacgtcgagctcgccatcggccagcggctgcggaagggcagcgtcggcgtgtggacggccatctccccgtacctcagtggagtagggctgggctgtgtcacgctgtccttcctgatcagcctgtactacaacaccatcgtggcgtgggtgctgtggtacctcctcaactccttccagcacccgctgccctggagctcctgcccaccggacctcaacagaacagggtttgtggaggagtgccagggcagcagcgccgtgagctacttctggtaccggcagacactgaacatcacagccgacatcaatgacagtggctccatccagtggtggctgctcatctgcttggcagcctcctgggcagtcgtgtacatgtgtgtcatcaggggcattgagactacagggaaggtgatttacttcacagctttgttcccttacctggtcctgaccatctttctcatcagagggctgaccctgccaggggcaacaaaaggactcatctacttgttcactcccaacaacccccgggtgtggctggacgcagccacccagatattcttctctctgtccctggccttcggaggacacatcgcttttgcaagttacaactcgcccaggaatgactgccagaaggatgcggtggtcatcgccctggtcaacaggatgacctccctgtacgcgtccatcgctgtcttctctgtcctgggtgcctcgggcccgggcctggccttcgtcgtcttcacggagaccgacctccacatgccgggggctcctgtgtgggccatgctcttcttcgggatgctgttcaccttggggctatcgaccatgttcgggaccgtggaggcggtcatcacacccctgctggactctgggaactactggctggagattttcgacaattttgccgcttccccgaacctgctcatgttggcctttctcgaggttgtgggtgtcgtttatgtttatggaatgaaacggtga

SEQ ID NO: 29347 - DNA, 2121 bp, Homo sapiens
aatacaactgcagtggggctgcttgtggtttccaaacgtcggcagaggctggagacggctctctagtgctgggtgtggagtgaggcaccacccttgccctgaagcctggggcactcagtcaccatggctcatgccccagaaccggacccggccgcctgcgacctcggggatgagaggcccaagtgggacaacaaggcccagtacctcctgagctgcactgggtttgccgtgggactggggaacatttggcggttcccatacctgtgccagacctatggaggaggggccttcctcatcccctacgtcatcgcgctggtcttcgaggggatccccattttccacgtcgagctcgccatcggccagcggctgcggaagggcagcgtcggcgtgtggacggccatctccccgtacctcagtggagtagggctgggctgtgtcacgctgtccttcctgatcagcctgtactacaacaccatcgtggcgtgggtgctgtggtacctcctcaactccttccagcacccgctgccctggagctcctgcccaccggacctcaacagaacagggtttgtggaggagtgccagggcagcagcgccgtgagctacttctggtaccggcagacactgaacatcacagccgacatcaatgacagtggctccatccagtggtggctgctcatctgcttggcagcctcctgggcagtcgtgtacatgtgtgtcatcaggggcattgagactacagggaaggtgatttacttcacagctttgttcccttacctggtcctgaccatctttctcatcagagggctgaccctgccaggggcaacaaaaggactcatctacttgttcactcccaacatgcacattctccagaacccccgggtgtggctggacgcagccacccagatattcttctctctgtccctggccttcggaggacacatcgcttttgcaagttacaactcgcccaggaatgactgccagaaggatgcggtggtcatcgccctggtcaacaggatgacctccctgtacgcgtccatcgctgtcttctctgtcctggggttcaaagcaactaatgactacgagcactgcctggacagaaacatcctcagcctcatcaacgactttgacttcccagagcagagcatctccagggacgactacccagccgtcctcatgcacctgaacgccacctggcccaagagggtggcccagctccccctgaaggcctgcctcctggaagactttctggataagagtgcctcgggcccgggcctggccttcgtcgtcttcacggagaccgacctccacatgccgggggctcctgtgtgggccatgctcttcttcgggatgctgttcaccttggggctatcgaccatgttcgggaccgtggaggcggtcatcacacccctgctggacgtgggggtcctgcctagatgggtccccaaggaggccctgactgggctggtctgcctggtctgcttcctctccgccacctgcttcacgctgcagtctgggaactactggctggagattttcgacaattttgccgcttccccgaacctgctcatgttggcctttctcgaggttgtgggtgtcgtttatgtttatggaatgaaacggttctgcgatgacattgcgtggatgaccgggaggcggcccagcccctactggcggctgacctggagggtggtcagtcccctgctgctgaccatctttgtggcttacatcatcctcctgttctggaagccactgagatacaaggcctggaaccccaaatacgagctgttcccctcgcgtcaggagaagctctacccgggctgggcgcgcgccgcctgtgtgctgctgtccttgctgcccgtgctgtgggtcccggtggccgcgcttgctcagctgctcacccggcggaggcggacgtggagggacagggacgcgcgcccagacacggacatgcgcccggacacggacacgcgcccagacacggacatgcgcccggacacggacatgcgctgaagccggccggagcggggcctgcatgggcgggtctgtgggggggcttggcctgatggtgggcggggccccgcccacagggccgaccccaatacaccagcgactcaaccttga

SEQ ID NO: 29348 - DNA, 6308 bp, Homo sapiens
cgccgggccactgggagagtttatgtggccgaggcagacaagtggaattaggccttgctgcaggggacttcatttccttctcagtactggacccatttatgaggaggtggcttatgaaagtgtgatgttcgcgtatttcttgacaggcagtggcgtgatcttggctcactgcaacctccgactccctggttcaagcgattctcctgcctcagcctcctgagtggggattacaggccacagcaaacacaggtgtgcaggaaccgtttgtcatggaagccagggagcctgggaggcccacacccacctaccatcttgtccctaacaccagccagtcccaggtggaagaagatgtcagctcgccacctcaaaggtcctccgaaactatgcagctgaagaaggagatctccctgctgaatggggtcagcctggtggtgggcaacatgatcggctcagggatctttgtctcacccaagggtgtgctggtacacactgcctcctatgggatgtcactgattgtgtgggccattggtgggctcttctctgttgtgggtgccctttgttatgcagagctggggaccaccatcaccaagtcgggagccagctacgcttatattctagaggcctttgggggcttcattgccttcatccgcctgtgggtctcactgctagttgttgagcccaccggtcaggccatcatcgccatcacctttgccaactacatcatccagccgtccttccccagctgtgatcccccatacctggcctgccgtctcctggctgctgcttgcatatgtctgctgacatttgtgaactgtgcctatgtcaagtggggcacacgtgtgcaggacacgttcacttacgccaaggtcgtagcgctcattgccatcattgtcatgggccttgttaaactgtgccagggacactctgagcactttcaggacgcctttgagggttcctcctgggacatgggaaacctctctcttgccctctactctgccctcttctcttactcaggttgggacacccttaattttgtaacagaagaaatcaaaaacccagaaagaaatttgcccttggccattgggatttctatgccaattgtgacgctcatctacatcctgaccaatgtggcctattacacagtgctgaacatttcagatgtccttagcagtgatgctgtggctgtgacatttgctgaccagacgtttggcatgttcagctggaccatccccattgctgttgccctgtcctgctttgggggcctcaatgcatccatctttgcttcatcaaggttgttcttcgtgggctcccgggagggccacctaccggaccttctgtccatgatccacattgagcgttttacacctatccctgctttactgttcaattgcaccatggcactcatctacctcatcgtggaggatgttttccagcttatcaactacttcagcttcagctactggttcttcgtgggcctgtctgttgttggacagctctacctccgctggaaggagcccaagcggccccggcctctcaagctgagcgtgtttttccccatcgtgttctgcatatgctccgtgtttctggtgatagtgcccctcttcactgacaccattaattccctcattggcatcgggattgccctttctggagtccctttctacttcatgggtgtttacctgccagagtcccggaggccattgtttattcggaatgtcctggctgctatcaccagaggcacccagcagctttgcttttgtgtcctgactgagcttgatgtagccgaagaaaaaaaggatgagaggaaaactgactagaggtcagaggtggctttctgaggcctggaaggcaggccaaccagcaaaatcctgataacaagactctgtgggcccaactctcctgaattaaaggagccttttgacccaatcatatagtggggctcagggccagtgctcactcttattggtaagctataggagactcaggatctgggccaacctcaaggtgggggcttcagagggtggggggaagattggggaacggggggaatggtcatttagttttactcctgataggtagatgcagctcttacagatatttacttggtaaagtgcagtggggaagagggaatgctaggttgatagggctggtggcttctgaatttggtatttgaactaggagtccctatagaggggctgctttatgggaagtttttctctgaccaggtacaacacctgactttaaaggcctgaaatgctaccatttcttcctctggctcaaaattcttccctggggagagagttatattcccttatttattgatatttagtccagaacaccagttctaacgaagcatgcgtgtctcttcatctacaggatgcaataggctgattgtatttaaaaatcaaagtacccaaaactgagtccctttgggctcagaaatgtctgtggtattgggtcagactctgaccacaggttttatgctgtttagcacaatttctattgagtcttacctgcaacaatgaaccttaaagatttttttactcacgtacctgttacactttagcatacagatagatcatagatcacgttacaagcacttggctcaggtccagcaaggacagatgaacaaattcctgagtcagaagtctgttaatattgctgttttgaaggacaatcctttattttacttgagaccttacatctttgttctagctgacagtaaatctctgggtttctgttacgaactctaagagggctgaaacttctgatattcaggtggatcacctgaattctctcagctgtcaatggcttggagaacatctcatgggcccaagtcatcaaataacctgttcctctctgtaagggcagtgtgagggactgctgtgcagacccaagcaatcccaacctggtgctaggtcatttcacttttctgaaaacctcacatcaggctgcatcctcttctgtccctggcaccaggctttgtttacacttggagccaccttggtgtgggtcaccgggacagtgtactcctctcctgccagcctccccttccccgaggtgtggtggctgcagtctcaggaagagcttggtacttgtggggacttctgttttctccctgtggagatcagtgaagactgggaggaaagctgcttcaacctgagtccggctcttcagcaggctgcacaagtggaagcaactaattctggtgctcaggctgggctctccacccaagttaggcctgctctggcctaatggatcttactgtatgagcaggacggctgcattggattgtacaactgttttgtgatgcccccagacactgtcatcctgggccgagaagaacctgctagcttgacataccccatgggcttatccttaggttttggaattggtcaacagtgaggcagtctcccttcctgaccattcttctccacccagtcacagataagggaataaccttggccatatatttgctcaataaagattgaaggaagcatggtcatagttgccctgggttcagagcataatgcatatgtgaagcatggggtgacattcctactgtcatgggtttgggatttgtaacggcaaattcctgcccgacgacagggtgtcttatgcaaaggctgacttgcctgaacgctaagaacatgacttctgtctgagctaagctggcacccatcccagggctcctctggagctaatcctttaagcaaaatgtgcttgccttttaaagatccctgaccccagctttagctttctccaccagataaccagctaatcccaggaatttgctgccccccaccagtggcttctagggaaagcaaggacctcacatgccaggtgccctagtacttgcttagtgagccatgtcatcctcctttcatttttggatggtgacagcatttttcccctctgtgctggatacagacttctcccaggatcctctctttgggagcgaagccagaggatccctacagcactcaagcttcatggtggaattaatttctgccagctctttgttgtctgtctccttaaatccttttcctggtgtgcttattatcccttttgcagtgagtacagtttattaagttgtcagccctttaatattggggaaacttaatgagtataaatagcagggagcacattgtaacagcacagtgttttgtttttttcacccggttgctgtatgagaatggctttcaatcctttgtttctatgcctacagacagaaagcaagatgtctaatattagacatacaagttgctgcctgttataacggtgaattatacctttgtgcatgcctaggatgtttgttgttttaattagctgcaatatatacggcctgtgtacacagaatttaatcacttcggcaggttgaacaactccatgtagataagagcaagtgtaggcaaaggtttagaaaatggacataaagtcaaagaatgatggcaggtaggatgaaggagagatacttaggaaatcctaaaagaggcggcaagaaggtacctccctgtgtaactcaccttcccccatgacagtgagtaagagacactcacaggctatgagggtacacccctagctgaatgttctgtgttgtttccttagacctgtggtgtccgctgcaacagctactagccacgtgtagctaattacattaaaatgaaataaaattaaaagctcagtttctcagttgcgctaatcacatttcaagtgctcagcagccacccgtgtctactactacacagtgcagacacagaacatatcatcactgcagatagttctactggacaatgttacgctagaataaacaccaaggcagtcagttaaggcagctatggtttggaaaggcatacggacagagtctgcttagaagagatacaagttgttaataaaattgatcctgttgatagtagtttgtttttgtggtgggtgctgtgaagagtaaacattactcagtggaaagctaagttcagaaggtactttgtttttcctcccttgccttaagtccttggtatttataatcaatgctgaaccttctatttcactaccgctccctgttttagatattcagatttaaaaggttttcaaagaattactttcttccatgttcaaagctagattttactaaacacatgtatcacattcatatatattgtttcttggccccactgccaaaggaagtcagtcagtaatttcacaaccgttatcagagtttggaagcagaaatagctgttaactaaaatctcccactgctcagactactttctgccctaatggccattactatccagtctgtattgctacaagggacccactggtaccccttttagattctatcaaaaggaacagggttttcctagaggcaggcagcctggtggtatggcacagcagaagcttactgctaatgaaatgggaacctccccctcccttgtggtttcagcacagaacctgaatgccaggaaaaattcctgggccaagaagctaaagctaaagaaaccttccttttttcaacgtttttttttctttcaaactgtagggtcacttttgattgaggcaaaggggtcctactgtaagtggaaaagactcactcccctaacataagttttcactgtggtgggatggtgccgcccgatatgcttgatatgcttttccttccacatgttaagctaggaaacctaacaggatgtcagcagggcagttaactctggactcagagccctcaagggcatgtggcagaacctcatggacatcacaagaccatcagtctgaatccaggtcgtgggggctgtcatagccgaactccttctgcacatccagagggtacttgctccacatccgctgtctgctgctgcctctttcctcctcactcaggctgttgtagtcagcagagcctagaatgacatcccgggagtggattctaaatgtgattttcctaggctactgcaggagccccttctcttctcagaaaggtctgtttttgttcccgattgtaatgcaaaatccttgctcaataaataaaaaagaatatagaattcttttttttttaaagaaggaatcactttcctatcatctaaaccaagttccttcacactggagtattttgtcacttctcccctccgtggagtattttgtcacttctcccctccgtataggattttttgttgttgtaagagttgtagtcatattgtaaatatttttgtacctttctccttttaacgtgttattgacaaacctccccaaaagaatatgcaattgtttgattcatttctctgttatcagacaccaataaattctttttgttgggc

SEQ ID NO: 29349 - DNA, 4575 bp, Homo sapiens
gcggggttcctgacgcagctgcgggcggcgggcggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagaccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctaccgctga

SEQ ID NO: 29350 - DNA, 1380 bp, Homo sapiens
tgtgctggtgatctaccccaccaaccaggctgtcatcgccctcaccttctccaactacgtgctgcagccgctcttccccacctgcttccccccagagtctggccttcggctcctggctgccatctgcttattgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacatttggaggagttaatgggtctctcttcacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactatgtgggcttcatcaactacctcttctatggggtcacggttgctggacagatagtccttcgctggaagaagcctgatatcccccgccccatcaagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattgagctgctaaccctggtgagccagaagatgtgtgtggtcgtgtaccccgaggtggaggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcctgccaacacatgcgagtacacacacacccctctctctgcttttgtcaggcagtggtaggactttggtgtgggtggtgagaaattgt

SEQ ID NO: 29351 - DNA, 4216 bp, Homo sapiens
tcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccaaagcaggtggaaaccagatctagagcaacaccgtcaggttcacagtttgtttttctagaagagaagaaagtacctgaggattgctcttttttcctaccgttaatgaaaactacttttgtcttcatcataaaagaaaaaactaaggggaggtaaaggcagtctcctgttttattagggggagaggtgaagggaaatccaggctcactttctgaataagccactgcctggtgcacagagcagaaccatcctggtttctgaagacacatccctttcagcagaattccagccggagtcgctggcacagttctatttttatatttaaatgtatgtctcccctggcctttttttttttttttttttttagcaacacttttcttgtttgtaaacgcgagtgaccagaaagtgtgaatgcggagtaggaatatttttcgtgttctcttttatctgcttgccttttttagagagtagcagtggttcctatttcggaaaaggacgttctaattcaaagctctctcccaatatatttacacgaatacgcatttagaaagggaggcagcttttgaggttgcaatcctactgagaaggatggaagaaggagccaggcaccgaaacaacaccgaaaagaaacacccaggtgggggcgagtcggacgccagccccgaggctggttccggagggggcggagtagccctgaagaaagagatcggattggtcagtgcctgtggtatcatcgtagggaacatcatcggctctggaatctttgtctcgccaaagggagtgctggagaatgctggttctgtgggccttgctctcatcgtctggattgtgacgggcttcatcacagttgtgggagccctctgctatgctgaactcggggtcaccatccccaaatctggaggtgactactcctatgtcaaggacatcttcggaggactggctgggttcctgaggctgtggattgctgtgctggtgatctaccccaccaaccaggctgtcatcgccctcaccttctccaactacgtgctgcagccgctcttccccacctgcttccccccagagtctggccttcggctcctggctgccatctgcttattgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacatttggaggagttaatgggtctctcttcacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactatgtgggcttcatcaactacctcttctatggggtcacggttgctggacagatagtccttcgctggaagaagcctgatatcccccgccccatcaagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattgagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcctgccaacacatgcgagtacacacacacccctctctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgtccccatcaaggggtcagctggagagacccaagaccctatctgttcaccagggacccaaaatccaaggggatgcttccctctgccctctttcctgcccctccccatcatacctgcacccaccccagccagggctccctgtccagaattcggttctcctcaggacgccaactcccagagctaaggaccaaggagaagaacagcctctccacccccaagccaggcggttgaggaacatattgagaaaggttcagattgcagaaacccagccctgcccctgcctcctgcatccagcccccaacatggtgccaaagcttccagaagccaaaaagcttctgatttttaaggtagtgggcatctctctcctaatgacgaagctgctcagcaactccacctgcccgccgcaggaaggagcagtcccctgctatccctgcagccactcccagcacacccgcacacagccagcaccaccgcccccaccgtgcacttctcctctctgggccttggcttgggaccaggtacgaaggatccccaagcccttcaggcctgagatcagagccagatcagccttaagtcacctcccatccaagaacttggcctaaaaatactcccctatttctaaccctcaggacggatctgatattaaatgccttccctgggaggaagggtgctttccccctccctagaggtgcccattccataccctgggagactgaggagagcattggctgaagcccagttcctttcccatccatccccaactccaataatcccccactcctcgcaggtctcagtgtcatgctgtcttggggcagggtgaaagggtagtggcagcagggcgcccactctggagatcctcaaaaaaggccctcctctgtggctggcagcctctgacctttccctgggcttcaaaggaaggctatggagtttgctgtgggccctgcaaccttcccagccactcctgctgcactaaggacttaggatccttttatcacaaatcgggattctctcccccaccccgaattctgtctgcttaaactggaatacacaggagcccttcctggcctggatggtgtctcccagcttccccgcccagcttgcccaccccatagttggtgagatgccaagtttggtctgagttgtgaccccttcagagtagatgcccggcaggctggggttggcccctggagggtcaggggaccatcttcttattccctcttttctcattcctccaacttcctcccctccttcaattatttttttgtaaagttgatgccttactttttggataaatatttttgaagctggtatttctatttcttttggattttttttaatgtaaggttgttttgggggatggagttagaaccttaatgataatttctttcgtttggtgtaggttttagagatttgttttgtggagaggtttttttcttttgatgtaataaaatttaaaatggaaatgaa

SEQ ID NO: 29352 - DNA, 4212 bp, Homo sapiens
tcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccaaagcaggtggaaaccagatctagagcaacaccgtcaggttcacagtttgtttttctagaagagaagaaagtacctgaggattgctcttttttcctaccgttaatgaaaactacttttgtcttcatcataaaagaaaaaactaaggggaggtaaaggcagtctcctgttttattagggggagaggtgaagggaaatccaggctcactttctgaataagccactgcctggtgcacagagcagaaccatcctggtttctgaagacacatccctttcagcagaattccagccggagtcgctggcacagttctatttttatatttaaatgtatgtctcccctggcctttttttttttttttttttttagcaacacttttcttgtttgtaaacgcgagtgaccagaaagtgtgaatgcggagtaggaatatttttcgtgttctcttttatctgcttgccttttttagagagtagcagtggttcctatttcggaaaaggacgttctaattcaaagctctctcccaatatatttacacgaatacgcatttagaaagggaggcagcttttgaggttgcaatcctactgagaaggatggaagaaggagccaggcaccgaaacaacaccgaaaagaaacacccaggtgggggcgagtcggacgccagccccgaggctggttccggagggggcggagtagccctgaagaaagagatcggattggtcagtgcctgtggtatcatcgtagggaacatcatcggctctggaatctttgtctcgccaaagggagtgctggagaatgctggttctgtgggccttgctctcatcgtctggattgtgacgggcttcatcacagttgtgggagccctctgctatgctgaactcggggtcaccatccccaaatctggaggtgactactcctatgtcaaggacatcttcggaggactggctgggttcctgaggctgtggattgctgtgctggtgatctaccccaccaaccaggctgtcatcgccctcaccttctccaactacgtgctgcagccgctcttccccacctgcttccccccagagtctggccttcggctcctggctgccatctgcttattgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacatttggaggagttaatgggtctctccacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactatgtgggcttcatcaactacctcttctatggggtcacggttgctggacagatagtccttcgctggaagaagcctgatatcccccgccccatcaagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattgagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcctgccaacacatgcgagtacacacacacccctctctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgtccccatcaaggggtcagctggagagacccaagaccctatctgttcaccagggacccaaaatccaaggggatgcttccctctgccctctttcctgcccctccccatcatacctgcacccaccccagccagggctccctgtccagaattcggttctcctcaggacgccaactcccagagctaaggaccaaggagaagaacagcctctccacccccaagccaggcggttgaggaacatattgagaaaggttcagattgcagaaacccagccctgcccctgcctcctgcatccagcccccaacatggtgccaaagcttccagaagccaaaaagcttctgatttttaaggtagtgggcatctctctcctaatgacgaagctgctcagcaactccacctgcccgccgcaggaaggagcagtcccctgctatccctgcagccactcccagcacacccgcacacagccagcaccaccgcccccaccgtgcacttctcctctctgggccttggcttgggaccaggtacgaaggatccccaagcccttcaggcctgagatcagagccagatcagccttaagtcacctcccatccaagaacttggcctaaaaatactcccctatttctaaccctcaggacggatctgatattaaatgccttccctgggaggaagggtgctttccccctccctagaggtgcccattccataccctgggagactgaggagagcattggctgaagcccagttcctttcccatccatccccaactccaataatcccccactcctcgcaggtctcagtgtcatgctgtcttggggcagggtgaaagggtagtggcagcagggcgcccactctggagatcctcaaaaaaggccctcctctgtggctggcagcctctgacctttccctgggcttcaaaggaaggctatggagtttgctgtgggccctgcaaccttcccagccactcctgctgcactaaggacttaggatccttttatcacaaatcgggattctctcccccaccccgaattctgtctgcttaaactggaatacacaggagcccttcctggcctggatggtgtctcccagcttccccgcccagcttgcccaccccatagttggtgagatgccaagtttggtctgagttgtgaccccttcagagtagatgcccggcaggctggggttggcccctggagggtcaggggaccatcttcttattccctcttttctcattcctccaacttcctcccctccttcaattatttttttgtaaagttgatgccttactttttggataaatatttttgaagctggtatttctatttcttttggattttttttaatgtaaggttgttttgggggatggagttagaaccttaatgataatttctttcgtttggtgtaggttttagagatttgttttgtggagaggtttttttcttttgatgtaataaaatttaaaatggaaatg

SEQ ID NO: 29353 - DNA, 3066 bp, Homo sapiens
tgtgcctccaggagcactcacagccctcacagcttctctgcaccctcctcctctgctggtgtgtccttggaagagagaggcccttccggaaggctcagagcacctcctctcctttggagggggttccgagatttctaaaacgtttgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactatgtgggcttcatcaactacctcttctatggggtcacggttgctggacagatagtccttcgctggaagaagcctgatatcccccgccccatcaagcccctgccctaccaggggtgagtgtgggaccacagagccgagggaagcccagcctttgcccttgaggatgtgtctctgtgggtgaagaagagagagaatgccccagtccctagtcctgggggccacgtggcctacacagttcatacgcctcatgcctctgctccacagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattgagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcctgccaacacatgcgagtacacacacacccctctctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgtccccatcaaggggtcagctggagagacccaagaccctatctgttcaccagggacccaaaatccaaggggatgcttccctctgccctctttcctgcccctccccatcatacctgcacccaccccagccagggctccctgtccagaattcggttctcctcaggacgccaactcccagagctaaggaccaaggagaagaacagcctctccacccccaagccaggcggttgaggaacatattgagaaaggttcagattgcagaaacccagccctgcccctgcctcctgcatccagcccccaacatggtgccaaagcttccagaagccaaaaagcttctgatttttaaggtagtgggcatctctctcctaatgacgaagctgctcagcaactccacctgcccgccgcaggaaggagcagtcccctgctatccctgcagccactcccagcacacccgcacacagccagcaccaccgcccccaccgtgcacttctcctctctgggccttggcttgggaccaggtacgaaggatccccaagcccttcaggcctgagatcagagccagatcagccttaagtcacctcccatccaagaacttggcctaaaaatactcccctatttctaaccctcaggacggatctgatattaaatgccttccctgggaggaagggtgctttccccctccctagaggtgcccattccataccctgggagactgaggagagcattggctgaagcccagttcctttcccatccatccccaactccaataatcccccactcctcgcaggtctcagtgtcatgctgtcttggggcagggtgaaagggtagtggcagcagggcgcccactctggagatcctcaaaaaaggccctcctctgtggctggcagcctctgacctttccctgggcttcaaaggaaggctatggagtttgctgtgggccctgcaaccttcccagccactcctgctgcactaaggacttaggatccttttatcacaaatcgggattctctcccccaccccgaattctgtctgcttaaactggaatacacaggagcccttcctggcctggatggtgtctcccagcttccccgcccagcttgcccaccccatagttggtgagatgccaagtttggtctgagttgtgaccccttcagagtagatgcccggcaggctggggttggcccctggagggtcaggggaccatcttcttattccctcttttctcattcctccaacttcctcccctccttcaattatttttttgtaaagttgatgccttactttttggataaatatttttgaagctggtatttctatttcttttggattttttttaatgtaaggttgttttgggggatggagttagaaccttaatgataatttctttcgtttggtgtaggttttagagatttgttttgtggagaggtttttttcttttgatgtaataaaatttaaaatggaaatgaa

SEQ ID NO: 29354 - DNA, 1499 bp, Homo sapiens
agcctgggcacccagacccagagggctgctgggagggacatgcctcaccccttttgctccagctggaggggagggagtctgtgggagctggccagagcgtggcagaaggcagagaagtgaacgccccagcaaaagtgctcctcacatgggtcaactgttccagtgtgcggtgggccacccgggttcaagacatcttcacagctgggaagctcctggccttggccctgattatcatcatggggattgtacagatatgcaaaggaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacatttggaggagttaatgggtctctcttcacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactatgtgggcttcatcaactacctcttctatggggtcacggttgctggacagatagtccttcgctggaagaagcctgatatcccccgccccatcaagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattgagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcctgccaacacatgcgagtacacacacacccctctctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgt

SEQ ID NO: 29355 - DNA, 1752 bp, Homo sapiens
caacctccagcctgggcacccagacccagagggctgctgggagggacatgcctcaccccttttgctccagctggaggggagggagtctgtgggagctggccagagcgtggcagaaggcagagaagtgaacgccccagcaaaagtgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacatttggaggagttaatgggtctctcttcacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactatgtgggcttcatcaactacctcttctatggggtcacggttgctggacagatagtccttcgctggaagaagcctgatatcccccgccccatcaagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattgagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcctgccaacacatgcgagtacacacacacccctctctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgtccccatcaaggggtcagctggagagacccaagaccctatctgttcaccagggacccaaaatccaaggggatgcttccctctgccctctttc

SEQ ID NO: 29356 - DNA, 536 bp, Homo sapiens
aagagaagcacgttagtgtgtggagaagccactctcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccaaagcaggtggaaaccagatctagagcaacaccgtcagaaagggaggcagcttttgaggttgcaatcctactgagaaggatggaagaaggagccaggcaccgaaacaacaccgaaaagaaacacccaggtgggggcgagtcggacgccagccccgaggctggttccggagggggcggagtagccctgaagaaagagatcggattggtcagtgcctgtggtatcatcgtagggaacatcatcggctctggaatctttgtctcgccaaagggagtgctggagaatgctggttctgtgggccttgctctcatcgtctggattgtgacgggcttcatcacagttgtgggagccctctgctatgctg

SEQ ID NO: 29357 - DNA, 658 bp, Homo sapiens
gaagccactctcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccaaagcaggtggaaaccagatctagagcaacaccgtcaggttcacagtttgtttttctagaagagaagaaagtacctgaggattgctcttttttcctaccgttaatgaaaactacttttgtcttcatcataaaagaaaaaactaaggggagagagtagcagtggttcctatttcggaaaaggacgttctaattcaaagctctctcccaatatatttacacgaatacgcatttagaaagggaggcagcttttgaggttgcaatcctactgagaaggatggaagaaggagccaggcaccgaaacaacaccgaaaagaaacacccaggtgggggcgagtcggacgccagccccgaggctggttccggagggggcggagtagccctgaagaaagagatcggattggtcagtgcctgtggtatcatcgtagggaacatcatcggctctggaatctttgtctcgccaaagggagtgctggagaatgctggttctgtgggccttgctctcatcgtc

SEQ ID NO: 29358 - DNA, 1819 bp, Homo sapiens
gtggtgattcagcagaaaccccagctccagcagctggcgcaggagctaacaggataagaaggaaggggaagagagagccaggaagggaggaggggaggggatggggcagtatgggcaggagcttagctggaagtgtttggtaaaagctgtgtgcctccaggagcactcacagccctcacagcttctctgcaccctcctcctctgctggtgtgtccttggaagagagaggcccttccggaaggctcagagcacctcctctcctttggagggggttccgagatttctaaaacgtttgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacatttggaggagttaatgggtctctcttcacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactatgtgggcttcatcaactacctcttctatggggtcacggttgctggacagatagtccttcgctggaagaagcctgatatcccccgccccatcaagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattgagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcctgccaacacatgcgagtacacacacacccctctctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgtccccatca

SEQ ID NO: 29359 - DNA, 6261 bp, Homo sapiens
gctgccgcggcggcggcggcgcgaccgagcatcctggcggcgccgggccactgggagagtttatgtggccgaggcagacaagtggaattaggccttgctgcaggggacttcatttccttctcagtactggacccatttatgaggaggtggcttatgaaagtgtgatgttcgcgtatttcttgacaggccacagcaaacacaggtgtgcaggaaccgtttgtcatggaagccagggagcctgggaggcccacacccacctaccatcttgtccctaacaccagccagtcccaggtggaagaagatgtcagctcgccacctcaaaggtcctccgaaactatgcagctgaagaaggagatctccctgctgaatggggtcagcctggtggtgggcaacatgatcggctcagggatctttgtctcacccaagggtgtgctggtacacactgcctcctatgggatgtcactgattgtgtgggccattggtgggctcttctctgttgtgggtgccctttgttatgcagagctggggaccaccatcaccaagtcgggagccagctacgcttatattctagaggcctttgggggcttcattgccttcatccgcctgtgggtctcactgctagttgttgagcccaccggtcaggccatcatcgccatcacctttgccaactacatcatccagccgtccttccccagctgtgatcccccatacctggcctgccgtctcctggctgctgcttgcatatgtctgctgacatttgtgaactgtgcctatgtcaagtggggcacacgtgtgcaggacacgttcacttacgccaaggtcgtagcgctcattgccatcattgtcatgggccttgttaaactgtgccagggacactctgagcactttcaggacgcctttgagggttcctcctgggacatgggaaacctctctcttgccctctactctgccctcttctcttactcaggttgggacacccttaattttgtaacagaagaaatcaaaaacccagaaagaaatttgcccttggccattgggatttctatgccaattgtgacgctcatctacatcctgaccaatgtggcctattacacagtgctgaacatttcagatgtccttagcagtgatgctgtggctgtgacatttgctgaccagacgtttggcatgttcagctggaccatccccattgctgttgccctgtcctgctttgggggcctcaatgcatccatctttgcttcatcaaggttgttcttcgtgggctcccgggagggccacctaccggaccttctgtccatgatccacattgagcgttttacacctatccctgctttactgttcaattgcaccatggcactcatctacctcatcgtggaggatgttttccagcttatcaactacttcagcttcagctactggttcttcgtgggcctgtctgttgttggacagctctacctccgctggaaggagcccaagcggccccggcctctcaagctgagcgtgtttttccccatcgtgttctgcatatgctccgtgtttctggtgatagtgcccctcttcactgacaccattaattccctcattggcatcgggattgccctttctggagtccctttctacttcatgggtgtttacctgccagagtcccggaggccattgtttattcggaatgtcctggctgctatcaccagaggcacccagcagctttgcttttgtgtcctgactgagcttgatgtagccgaagaaaaaaaggatgagaggaaaactgactagaggtcagaggtggctttctgaggcctggaaggcaggccaaccagcaaaatcctgataacaagactctgtgggcccaactctcctgaattaaaggagccttttgacccaatcatatagtggggctcagggccagtgctcactcttattggtaagctataggagactcaggatctgggccaacctcaaggtgggggcttcagagggtggggggaagattggggaacggggggaatggtcatttagttttactcctgataggtagatgcagctcttacagatatttacttggtaaagtgcagtggggaagagggaatgctaggttgatagggctggtggcttctgaatttggtatttgaactaggagtccctatagaggggctgctttatgggaagtttttctctgaccaggtacaacacctgactttaaaggcctgaaatgctaccatttcttcctctggctcaaaattcttccctggggagagagttatattcccttatttattgatatttagtccagaacaccagttctaacgaagcatgcgtgtctcttcatctacaggatgcaataggctgattgtatttaaaaatcaaagtacccaaaactgagtccctttgggctcagaaatgtctgtggtattgggtcagactctgaccacaggttttatgctgtttagcacaatttctattgagtcttacctgcaacaatgaaccttaaagatttttttactcacgtacctgttacactttagcatacagatagatcatagatcacgttacaagcacttggctcaggtccagcaaggacagatgaacaaattcctgagtcagaagtctgttaatattgctgttttgaaggacaatcctttattttacttgagaccttacatctttgttctagctgacagtaaatctctgggtttctgttacgaactctaagagggctgaaacttctgatattcaggtggatcacctgaattctctcagctgtcaatggcttggagaacatctcatgggcccaagtcatcaaataacctgttcctctctgtaagggcagtgtgagggactgctgtgcagacccaagcaatcccaacctggtgctaggtcatttcacttttctgaaaacctcacatcaggctgcatcctcttctgtccctggcaccaggctttgtttacacttggagccaccttggtgtgggtcaccgggacagtgtactcctctcctgccagcctccccttccccgaggtgtggtggctgcagtctcaggaagagcttggtacttgtggggacttctgttttctccctgtggagatcagtgaagactgggaggaaagctgcttcaacctgagtccggctcttcagcaggctgcacaagtggaagcaactaattctggtgctcaggctgggctctccacccaagttaggcctgctctggcctaatggatcttactgtatgagcaggacggctgcattggattgtacaactgttttgtgatgcccccagacactgtcatcctgggccgagaagaacctgctagcttgacataccccatgggcttatccttaggttttggaattggtcaacagtgaggcagtctcccttcctgaccattcttctccacccagtcacagataagggaataaccttggccatatatttgctcaataaagattgaaggaagcatggtcatagttgccctgggttcagagcataatgcatatgtgaagcatggggtgacattcctactgtcatgggtttgggatttgtaacggcaaattcctgcccgacgacagggtgtcttatgcaaaggctgacttgcctgaacgctaagaacatgacttctgtctgagctaagctggcacccatcccagggctcctctggagctaatcctttaagcaaaatgtgcttgccttttaaagatccctgaccccagctttagctttctccaccagataaccagctaatcccaggaatttgctgccccccaccagtggcttctagggaaagcaaggacctcacatgccaggtgccctagtacttgcttagtgagccatgtcatcctcctttcatttttggatggtgacagcatttttcccctctgtgctggatacagacttctcccaggatcctctctttgggagcgaagccagaggatccctacagcactcaagcttcatggtggaattaatttctgccagctctttgttgtctgtctccttaaatccttttcctggtgtgcttattatcccttttgcagtgagtacagtttattaagttgtcagccctttaatattggggaaacttaatgagtataaatagcagggagcacattgtaacagcacagtgttttgtttttttcacccggttgctgtatgagaatggctttcaatcctttgtttctatgcctacagacagaaagcaagatgtctaatattagacatacaagttgctgcctgttataacggtgaattatacctttgtgcatgcctaggatgtttgttgttttaattagctgcaatatatacggcctgtgtacacagaatttaatcacttcggcaggttgaacaactccatgtagataagagcaagtgtaggcaaaggtttagaaaatggacataaagtcaaagaatgatggcaggtaggatgaaggagagatacttaggaaatcctaaaagaggcggcaagaaggtacctccctgtgtaactcaccttcccccatgacagtgagtaagagacactcacaggctatgagggtacacccctagctgaatgttctgtgttgtttccttagacctgtggtgtccgctgcaacagctactagccacgtgtagctaattacattaaaatgaaataaaattaaaagctcagtttctcagttgcgctaatcacatttcaagtgctcagcagccacccgtgtctactactacacagtgcagacacagaacatatcatcactgcagatagttctactggacaatgttacgctagaataaacaccaaggcagtcagttaaggcagctatggtttggaaaggcatacggacagagtctgcttagaagagatacaagttgttaataaaattgatcctgttgatagtagtttgtttttgtggtgggtgctgtgaagagtaaacattactcagtggaaagctaagttcagaaggtactttgtttttcctcccttgccttaagtccttggtatttataatcaatgctgaaccttctatttcactaccgctccctgttttagatattcagatttaaaaggttttcaaagaattactttcttccatgttcaaagctagattttactaaacacatgtatcacattcatatatattgtttcttggccccactgccaaaggaagtcagtcagtaatttcacaaccgttatcagagtttggaagcagaaatagctgttaactaaaatctcccactgctcagactactttctgccctaatggccattactatccagtctgtattgctacaagggacccactggtaccccttttagattctatcaaaaggaacagggttttcctagaggcaggcagcctggtggtatggcacagcagaagcttactgctaatgaaatgggaacctccccctcccttgtggtttcagcacagaacctgaatgccaggaaaaattcctgggccaagaagctaaagctaaagaaaccttccttttttcaacgtttttttttctttcaaactgtagggtcacttttgattgaggcaaaggggtcctactgtaagtggaaaagactcactcccctaacataagttttcactgtggtgggatggtgccgcccgatatgcttgatatgcttttccttccacatgttaagctaggaaacctaacaggatgtcagcagggcagttaactctggactcagagccctcaagggcatgtggcagaacctcatggacatcacaagaccatcagtctgaatccaggtcgtgggggctgtcatagccgaactccttctgcacatccagagggtacttgctccacatccgctgtctgctgctgcctctttcctcctcactcaggctgttgtagtcagcagagcctagaatgacatcccgggagtggattctaaatgtgattttcctaggctactgcaggagccccttctcttctcagaaaggtctgtttttgttcccgattgtaatgcaaaatccttgctcaataaataaaaaagaatatagaattcttttttttttaaagaaggaatcactttcctatcatctaaaccaagttccttcacactggagtattttgtcacttctcccctccgtggagtattttgtcacttctcccctccgtataggattttttgttgttgtaagagttgtagtcatattgtaaatatttttgtacctttctccttttaacgtgttattgacaaacctccccaaaagaatatgcaattgtttgattcatttctctgttatcagacaccaataaattctttttgttgggc

SEQ ID NO: 29360 - DNA, 5074 bp, Homo sapiens
gcatcctggcggcgccgggccactgggagagtttatgtggccgaggcagacaagtggaattaggccttgctgcaggggacttcatttccttctcagtactggacccatttatgaggaggtggcttatgaaagtgtgatgttcgcgtatttcttgacaggccacagcaaacacaggtgtgcaggaaccgtttgtcatggaagccagggagcctgggaggcccacacccacctaccatcttgtccctaacaccagccagtcccaggtggaagaagatgtcagctcgccacctcaaaggtcctccgaaactatgcagctgaagaaggagatctccctgctgaatggggtcagcctggtggtgggcaacatgatcggctcagggatctttgtctcacccaagggtgtgctggtacacactgcctcctatgggatgtcactgattgtgtgggccattggtgggctcttctctgttgtgggtgccctttgttatgcagagctggggaccaccatcaccaagtcgggagccagctacgcttatattctagaggcctttgggggcttcattgccttcatccgcctgtgggtctcactgctagttgttgagcccaccggtcaggccatcatcgccatcacctttgccaactacatcatccagccgtccttccccagctgtgatcccccatacctggcctgccgtctcctggctgctgcttgcatatgtctgctgacatttgtgaactgtgcctatgtcaagtggggcacacgtgtgcaggacacgttcacttacgccaaggtcgtagcgctcattgccatcattgtcatgggccttgttaaactgtgccaggaaatttgcccttggccattgggatttctatgccaattgtgacgctcatctacatcctgaccaatgtggcctattacacagtgctgaacatttcagatgtccttagcagtgatgctgtggctgtgacatttgctgaccagacgtttggcatgttcagctggaccatccccattgctgttgccctgtcctgctttgggggcctcaatgcatccatctttgcttcatcaaggttgttcttcgtgggctcccgggagggccacctaccggaccttctgtccatgatccacattgagcgttttacacctatccctgctttactgttcaattgcaccatggcactcatctacctcatcgtggaggatgttttccagcttatcaactacttcagcttcagctactggttcttcgtgggcctgtctgttgttggacagctctacctccgctggaaggagcccaagcggccccggcctctcaagctgagcgtgtttttccccatcgtgttctgcatatgctccgtgtttctggtgatagtgcccctcttcactgacaccattaattccctcattggcatcgggattgccctttctggagtccctttctacttcatgggtgtttacctgccagagtcccggaggccattgtttattcggaatgtcctggctgctatcaccagaggcacccagcagctttgcttttgtgtcctgactgagcttgatgtagccgaagaaaaaaaggatgagaggaaaactgactagaggtcagaggtggctttctgaggcctggaaggcaggccaaccagcaaaatcctgataacaagactctgtgggcccaactctcctgaattaaaggagccttttgacccaatcatatagtggggctcagggccagtgctcactcttattggctttgtttacacttggagccaccttggtgtgggtcaccgggacagtgtactcctctcctgccagcctccccttccccgaggtgtggtggctgcagtctcaggaagagcttggtacttgtggggacttctgttttctccctgtggagatcagtgaagactgggaggaaagctgcttcaacctgagtccggctcttcagcaggctgcacaagtggaagcaactaattctggtgctcaggctgggctctccacccaagttaggcctgctctggcctaatggatcttactgtatgagcaggacggctgcattggattgtacaactgttttgtgatgcccccagacactgtcatcctgggccgagaagaacctgctagcttgacataccccatgggcttatccttaggttttggaattggtcaacagtgaggcagtctcccttcctgaccattcttctccacccagtcacagataagggaataaccttggccatatatttgctcaataaagattgaaggaagcatggtcatagttgccctgggttcagagcataatgcatatgtgaagcatggggtgacattcctactgtcatgggtttgggatttgtaacggcaaattcctgcccgacgacagggtgtcttatgcaaaggctgacttgcctgaacgctaagaacatgacttctgtctgagctaagctggcacccatcccagggctcctctggagctaatcctttaagcaaaatgtgcttgccttttaaagatccctgaccccagctttagctttctccaccagataaccagctaatcccaggaatttgctgccccccaccagtggcttctagggaaagcaaggacctcacatgccaggtgccctagtacttgcttagtgagccatgtcatcctcctttcatttttggatggtgacagcatttttcccctctgtgctggatacagacttctcccaggatcctctctttgggagcgaagccagaggatccctacagcactcaagcttcatggtggaattaatttctgccagctctttgttgtctgtctccttaaatccttttcctggtgtgcttattatcccttttgcagtgagtacagtttattaagttgtcagccctttaatattggggaaacttaatgagtataaatagcagggagcacattgtaacagcacagtgttttgtttttttcacccggttgctgtatgagaatggctttcaatcctttgtttctatgcctacagacagaaagcaagatgtctaatattagacatacaagttgctgcctgttataacggtgaattatacctttgtgcatgcctaggatgtttgttgttttaattagctgcaatatatacggcctgtgtacacagaatttaatcacttcggcaggttgaacaactccatgtagataagagcaagtgtaggcaaaggtttagaaaatggacataaagtcaaagaatgatggcaggtaggatgaaggagagatacttaggaaatcctaaaagaggcggcaagaaggtacctccctgtgtaactcaccttcccccatgacagtgagtaagagacactcacaggctatgagggtacacccctagctgaatgttctgtgttgtttccttagacctgtggtgtccgctgcaacagctactagccacgtgtagctaattacattaaaatgaaataaaattaaaagctcagtttctcagttgcgctaatcacatttcaagtgctcagcagccacccgtgtctactactacacagtgcagacacagaacatatcatcactgcagatagttctactggacaatgttacgctagaataaacaccaaggcagtcagttaaggcagctatggtttggaaaggcatacggacagagtctgcttagaagagatacaagttgttaataaaattgatcctgttgatagtagtttgtttttgtggtgggtgctgtgaagagtaaacattactcagtggaaagctaagttcagaaggtactttgtttttcctcccttgccttaagtccttggtatttataatcaatgctgaaccttctatttcactaccgctccctgttttagatattcagatttaaaaggttttcaaagaattactttcttccatgttcaaagctagattttactaaacacatgtatcacattcatatatattgtttcttggccccactgccaaaggaagtcagtcagtaatttcacaaccgttatcagagtttggaagcagaaatagctgttaactaaaatctcccactgctcagactactttctgccctaatggccattactatccagtctgtattgctacaagggacccactggtaccccttttagattctatcaaaaggaacagggttttcctagaggcaggcagcctggtggtatggcacagcagaagcttactgctaatgaaatgggaacctccccctcccttgtggtttcagcacagaacctgaatgccaggaaaaattcctgggccaagaagctaaagctaaagaaaccttccttttttcaacgtttttttttctttcaaactgtagggtcacttttgattgaggcaaaggggtcctactgtaagtggaaaagactcactcccctaacataagttttcactgtggtgggatggtgccgcccgatatgcttgatatgcttttccttccacatgttaagctaggaaacctaacaggatgtcagcagggcagttaactctggactcagagccctcaagggcatgtggcagaacctcatggacatcacaagaccatcagtctgaatccaggtcgtgggggctgtcatagccgaactccttctgcacatccagagggtacttgctccacatccgctgtctgctgctgcctctttcctcctcactcaggctgttgtagtcagcagagcctagaatgacatcccgggagtggattctaaatgtgattttcctaggctactgcaggagccccttctcttctcagaaaggtctgtttttgttcccgattgtaatgcaaaatccttgctcaataaataaaaaagaatatagaattcttttttttttaaagaaggaatcactttcctatcatctaaaccaagttccttcacactggagtattttgtcacttctcccctccgtggagtattttgtcacttctcccctccgtataggattttttgttgttgtaagagttgtagtcatattgtaaatatttttgtacctttctccttttaacgtgttattgacaaacctccccaaaagaatatgcaattgtttgattcatttctctgttatcagacaccaataaattctttttgttgggc

SEQ ID NO: 29361 - DNA, 2263 bp, Homo sapiens
atttcagtccccgttaccctctgctttttctgctcctcagagtcaacagctgttgcagcatgagcgatacgcttggttctcctaactagcaccttcccctctcccctgactcagctggtagcccctcctccccgcacctgcccaaaggtcactggacaggcatttgtctggccttcccttttactgctggctgggaaggaggagcatcagaccacagatcctggaaggcacttctctccctgactgctgctcacactgccgtgagaacctgcttatatccaggaccaaggagtgagtggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatttgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaaatctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcctaaa

SEQ ID NO: 29362 - DNA, 2098 bp, Homo sapiens
aatctcagcatgggaacaagcctttgtgtcacactgtgcaaccttcctccctttcttaaatgcttggggcatttgtctggccttcccttttactgctggctgggaaggaggagcatcagaccacagatcctggaaggcacttctctccctgactgctgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatttgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaaatctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttc

SEQ ID NO: 29363 - DNA, 2094 bp, Homo sapiens
atttcagtccccgttaccctctgctttttctgctcctcagagtcaacagctgttgcagcatgagcgatacgcttggttctcctaactagcaccttcccctctcccctgactcagctggtagcccctcctccccgcacctgcccaaaggtcactggacagggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatttgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaaatctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtg

SEQ ID NO: 29364 - DNA, 2447 bp, Homo sapiens
gcatggaggacacagagagagagagtgctgtgtattccttccccgctactgtcctgtcctcagctaacttgctctgggacagcttccccagggctacagatactgcactcagctgactgtcctttcttctgggcccctggtcccagagcagagctgacaaaggagattcctgagagagcaccttcttatcacagaaagtgctgagccaagagctcctagctgccccttttgcagatgtgaagggccagtgaaccttggacccagatggttgcttaatactcctttccccctccctcactccttcctttgcgggctgcctcacctcctccacccttcttgcttaaatccataggcatttgtctggccttcccttttactgctggctgggaaggaggagcatcagaccacagatcctggaaggcacttctctccctgactgctgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatttgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaaatctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcct

SEQ ID NO: 29365 - DNA, 1996 bp, Homo sapiens
cttttactgctggctgggaaggaggagcatcagaccacagatcctggaaggcacttctctccctgactgctgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatttgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaaatctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcct

SEQ ID NO: 29366 - DNA, 847 bp, Homo sapiens
atctgggttttcaatcacggctccgccatcttgggtcatcgtacggaaggagagacaaaactgcagtacaggtttttgagagctgtcaaatctctgctatatcagtactggctaaattaggtgttaaatgattgagcttcaagatgggcaaatcatgacttcggactacattcctccttgcctggcggctgggaaattccgtccgcgctgctgctaagacttcagatgaaagacgctccggggactccggcatttgtctggccttcccttttactgctggctgggaaggaggagcatcagaccacagatcctggaaggcacttctctccctgactgctgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaact

SEQ ID NO: 29367 - DNA, 741 bp, Homo sapiens
gtcaaatctctgctatatcagtactggctaaattaggtgttaaatgattgagcttcaagatgggcaaatcatgacttcggactacattcctccttgcctggcggctgggaaattcctgggagtgctgacagcaaacaaatgacaccgggaatggacaatatcactgggaagcatgttccaggcagggagaacaggagttgcaaaagctgtgaggcgggagcatgcttgctgtgcggccaccgcagggaagccagtgaagctggagtggagtggggaagacagcagggaggcccatgcagacaaggacagcttctctctttctaggacctcccttacgacttggacccgactccagagtgcaattaaggggccggcaagttgggtagcaggctgagagtgtctaaaggacactaaaatatctttggaataattcaggcatttgtctggccttcccttttactgctggctgggaaggaggagcatcagaccacagatcctggaaggcacttctctccctgactgctgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgc

SEQ ID NO: 29368 - DNA, 720 bp, Homo sapiens
tttgtgtcacactgtgcaaccttcctccctttcttaaatgcttggggcatttgtctggccttcccttttactgctggctgggaaggaggagcatcagaccacagatcctggaaggcacttctctccctgactgctgctcacactgccgtgagaacctgcttatatccaggaccaaggagtgagtggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctg

SEQ ID NO: 29369 - DNA, 519 bp, Homo sapiens
cattttcctctcagctgtctcctgttcggtgttttccagcatgtgctgcctggctgcagctgtctccctgccttggctcggggtgatatctctccagcagcaactctgggggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacct

SEQ ID NO: 29370 - DNA, 2272 bp, Homo sapiens
gttttcctgttttccatttcagtccccgttaccctctgctttttctgctcctcagagtcaacagctgttgcagcatgagcgatacgcttggttctcctaactagcaccttcccctctcccctgactcagctggtagcccctcctccccgcacctgcccaaaggtcactggacaggcatttgtctggccttcccttttactgctggctgggaaggaggagcatcagaccacagatcctggaaggcacttctctccctgactgctgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatttgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaaatctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcctaaa

SEQ ID NO: 29371 - DNA, 596 bp, Homo sapiens
cctttccccctccctcactccttcctttgcgggctgcctcacctcctccacccttcttgcttaaatccataggcatttgtctggccttcccttttactgctggctgggaaggaggagcatcagaccacagatcctggaaggcacttctctccctgactgctgctcacactgccgtgagaacctgcttatatccaggaccaaggagtgagtggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattcct

SEQ ID NO: 29372 - DNA, 476 bp, Homo sapiens
ttgcttaaatccataggcatttgtctggccttcccttttactgctggctgggaaggaggagcatcagaccacagatcctggaaggcacttctctccctgactgctgctcacactgccgtgagaacctgcttatatccaggaccaaggagtgagtggtgaagtgggtctacttgggctttgccagggctgaagactccagctaagggttaagggatgctctttgggcaggaggatggttgtgggtttccagcaggtttctgaagcctttagttttggcagacgtagagtccttggggaaaagagcagtgtcatgagacgctcccacagattagctgctggtaggggcaatgccaggaagctggtgaagggtttcctctcctccaccatggttgacagcactgagtatgaagtggcctcccagcctgaggtggaaacctcccctttgggtgatggggccagcccagggccggagcagg

SEQ ID NO: 29373 - DNA, 3017 bp, Homo sapiens
tggagtgcagtggcctaatgtgggttcactgcaagctccgcctcccgggttcatgccattctcctcattctcctgcctcagcctcccgaatagctgggactacaggtgcccgccaccacgcccggctaatttttatttttttgtgtttttagtagagacggggtttcaccgtgttagccaggatggtcttgatctcctgaccttgtgatccgcctgcctcagcctcccaaagtgctgggattacaggcgtgagccaccgcgtctggcctgatttcctcatattttttaggaaagtggagtcaacttatatttgaggaaggcgtttataggaatttatgcttatcccagagatcttggtatgttttgtcaagaatgaaaaggcacgtgggtctggtggggatgcagtcagatatttgatctcttgactgtgtttcttttgaagtagtctgaggctcagactttggggcagtggcccaggcttggaggcaaccccccagtctctctttgcatggggaagtgtgcagagttctcttagaacacccagtcacatggtgtagagactgctcttacacttcctgtaatctcagcatgggaacaagcctttgtgtcacactgtgcaaccttcctccctttcttaaatgcttggggtgagagagaagagaggctagggtggggcatggaggacacagagagagagagtgctgtgtattccttccccgctactgtcctgtcctcagctaacttgctctgggacagcttccccagggctacagatactgcactcagctgactgtcctttcttctgggcccctggtcccagagcagagctgacaaaggagattcctgagagagcaccttcttatcacagaaagtgctgagccaagagctcctagctgccccttttgcagatgtgaagggccagtgaaccttggacccagatggttgcttaatactcctttccccctccctcactccttcctttgcgggctgcctcacctcctccacccttcttgcttaaatccataggcatttgtctggccttcccttttactgctggctgggaaggaggagcatcagaccacagatcctggaaggcacttctctccctgactgctgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatttgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaaatctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcct

SEQ ID NO: 29374 - DNA, 572 bp, Homo sapiens
atattttttaggaaagtggagtcaacttatatttgaggaaggcgtttataggaatttatgcttatcccagagatcttggcatttgtctggccttcccttttactgctggctgggaaggaggagcatcagaccacagatcctggaaggcacttctctccctgactgctgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatat

SEQ ID NO: 29375 - DNA, 569 bp, Homo sapiens
ttgctgcccgacgccttcccagcttagtggagcccactttctttggcatttgtctggccttcccttttactgctggctgggaaggaggagcatcagaccacagatcctggaaggcacttctctccctgactgctgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcgggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgcttt

SEQ ID NO: 29376 - DNA, 7243 bp, Homo sapiens
gcggccgcgggctcccgctaaccgcagcctccactcctctccccgcgcgccgcgcccccgccccgccccgccccgcccggtctcgccggccgagcgtccgttggtccttgagcgcgtccgacagtctgtctgttcgcgatcctgccggagccccgccgccgccggcttggattctgaaaccttccttgtatccctcctgagacatctttgctgcaagatcgaggctgtcctctggtgagaaggtggtgaggcttcccgtcatattccagctctgaacagcaacatggggtgcaaagtcctgctcaacattgggcagcagatgctgcggcggaaggtggtggactgtagccgggaggagacgcggctgtctcgctgcctgaacacttttgatctggtggccctcggggtgggcagcacactgggtgctggtgtctacgtcctggctggagctgtggcccgtgagaatgcaggccctgccattgtcatctccttcctgatcgctgcgctggcctcagtgctggctggcctgtgctatggcgagtttggtgctcgggtccccaagacgggctcagcttacctctacagctatgtcaccgttggagagctctgggccttcatcaccggctggaacttaatcctctcctacatcatcggtacttcaagcgtagcgagggcctggagcgccaccttcgacgagctgataggcagacccatcggggagttctcacggacacacatgactctgaacgcccccggcgtgctggctgaaaaccccgacatattcgcagtgatcataattctcatcttgacaggacttttaactcttggtgtgaaagagtcggccatggtcaacaaaatattcacttgtattaacgtcctggtcctgggcttcataatggtgtcaggatttgtgaaaggatcggttaaaaactggcagctcacggaggaggattttgggaacacatcaggccgtctctgtttgaacaatgacacaaaagaagggaagcccggtgttggtggattcatgcccttcgggttctctggtgtcctgtcgggggcagcgacttgcttctatgccttcgtgggctttgactgcatcgccaccacaggtgaagaggtgaagaacccacagaaggccatccccgtggggatcgtggcgtccctcttgatctgcttcatcgcctactttggggtgtcggctgccctcacgctcatgatgccctacttctgcctggacaataacagccccctgcccgacgcctttaagcacgtgggctgggaaggtgccaagtacgcagtggccgtgggctccctctgcgctctttccgccagtcttctaggttccatgtttcccatgcctcgggttatctatgccatggctgaggatggactgctatttaaattcttagccaacgtcaatgataggaccaaaacaccaataatcgccacattagcctcgggtgccgttgctgctgtgatggccttcctctttgacctgaaggacttggtggacctcatgtccattggcactctcctggcttactcgttggtggctgcctgtgtgttggtcttacggtaccagccagagcagcctaacctggtataccagatggccagtacttccgacgagttagatccagcagaccaaaatgaattggcaagcaccaatgattcccagctgggctttttaccagaggcagagatgttctctttgaaaaccatactctcacccaaaaacatggagccttccaaaatctctgggctaattgtgaacatttcaaccagcctcatagctgttctcatcatcaccttctgcattgtgaccgtgcttggaagggaggctctcaccaaaggggcgctgtgggcagtctttctgctcgcagggtctgccctcctctgtgccgtggtcacgggcgtcatctggaggcagcccgagagcaagaccaagctctcatttaaggttcccttcctgccagtgctccccatcctgagcatcttcgtgaacgtctatctcatgatgcagctggaccagggcacctgggtccggtttgctgtgtggatgctgataggcttcatcatctactttggctatggcctgtggcacagcgaggaggcgtccctggatgccgaccaagcaaggactcctgacggcaacttggaccagtgcaagtgacgcacagccccgccccccggaggtggcagcagccccgagggacgcccccagaggaccgggaggcaccccaccctccccaccagtgcaacagaaaccacctgcgtccacaccctcactgcagccaaaggtgcaattacttgacctgcagccccagcccaccctcggctctgcagccggttctccgggccctggtcacctccagacagctgcctggccggggccactaggctgcggctggccactgtgtctcctcacttctctgaacaaagcagttcctcccctaccagctcagccccgagctgccgcagcctcaggcagaacggaggtcaccttctctccttatcttgggaaccaggccttcctcccggggactgttctgggattgaaattgtgcatactccaaactttcgcagccatcttcccgctcagccccagacacccagcaatcaagccagatgagtaccacaaaacagtgtgtccccagcagctccccaccccagagccaaatgacagtagtgcacttaaaaaggaaaatcaggcctgttgtccttctccggttgcattcagatgggtcattagggccggaccctgcctgccccttggcttctcagggctttgctctgacaccatgacagctgcccggggctgagggcagctggctccactcaaatgaggaagaagggatcactcccattagggcctgctttgcttatgcatgtgtgtgcacatgcatgtaaaccagggaccttcagctcacggcctccaggcctgggccagttcttgctgctcctgccgtctcccccgactggctgtgtcctgagtaactggaacatgagacagtatctgcaggactggccccatggtggccgagtcagaagtctgtttcctgtgagtcgccaccgttcactcagtcttgccctcccatgctttggagccagtctggtggctcctgtaaggttctcaaggctggtggcagctcagtctggggtcaggacatgtcggggtcatgcgtttctggccctgacataagctgtctggcctctctgtgacatgatgaaattgaaatcaatccacagtccatgaaattgtgacactccaccagattaagttagggcataacattaacttggaaatggccatgtcatcacccctgcggctgtcctatagctgagatgcgtgggtcgcaggggaggtgatttctaggcatattgctgtcccttttgtgtatctgtcatccggatgcttcggaccccacgcctctgcaagtgggagagacccgagcatcctccccacccccatagctccagtgcacgccacccccgtcttgcctgggtcggggcctgcggccagcaccatttcacacacactccttgtagatgggagccagaggaaacctgaacgtgggtggagcgttccactgagtctacttcaggagacagaaggcccatgctgatgggggaggaggagggatgtgggcattttggacaccaggggaaatggaaatgctgctttcaaaacttagtttcctttccatttcttcctagtctggcctttgacacaaatctggtagaaagaagcctgataaattgagggcacttgtaccctccctgtgcccccagaaggttcttggagagaagtgcaagaatttgtgaacacggcggtggagggcgggtggatggccatgggctgagcctccgtatcaggcctgctcaccttgctgggagctttattctgatctcattttgaatgttccagagggagcatcataagagcccagagctccgatttccaaagagtgatattgacatttatggagattggtgttgtaacatattttgataaatactaacttattttgttggggttttggttgtctcttgtcttaggacctggtagttatttgcttgatttttttttccgttattttctacataggcaaagagaattcgagggatagacagtctccaagaaaagtgaagtggtgggagagaattgcttttttcttttttttcttttctctagtttttctttctggctgagatttccgtgcaagacagcacccaatagactatttagagttgacatttgacattttaatgggcgccatggctcattttgtagattgagaaggtgcgtctcccctgctccaagtctcatcatgacagcgtgctgacagctgggagtctgtggccttcctcacgcagaggccttaaagctggacacagaagcacgcctaggctgggcagggatgggacccatgccccctccttagaggacgggcttcctggttaggaaaggacacgtgggggtgccttgcataatagttcactggtcaccgtgcttttatgagtagtgtttttgtgcacttgccaggggttttctctctgtgtgagaggggagtgatttaagcaatggtgtctggagtaagccttacaattttaatagactttttcttatcatatccctcatttctttccctgaaataaaaatacacacaagcaaaaaaaaaatgatagtttcacatctcttagttcccttgcccaaacaagaatattcttagttccactggccaggattttcctacatagtcagaacttacacattactagaggcacacccaccaaggagtattgtgtctacttttatctgtgcaccagccacaaatacccacattggaaagacccatttgtgatgggtaaacatcccttcctgtctcccacaacccctgtgactgccctgcatgtgttcatgacctccgaaggcccaaattcatgaagcagcaaacccagcagatctccacccccctgcctcaggacctctgctgaagagggggatgaagtgggtctccagggaggcagtgggggccttgttggcagctggctcgggagccggcttacaggagggcagctctgcagttgggaggggcaccgtccggaggagaccaggcctctacacaccccccactctacttatcatccctgctcacacacccttgtccaaggctttatgcatcggatttatttttccaaatcaagaggacagtgatagatgcattttccccaggctgtctcagaaaggtcgctaaatgtatactgttgtcagaattgctgagatctccccccacttttggtttttgcagcagtaaaaactctttccactgtgacttattttctctctcaggcagccagccacctggtcccttgtgctgactctagcacagtggccaggatccaatacgagtccaggggtgaccgcaggatggtgggggcagcgggcttctccacctaccccagccaccaaggccctgacgcactgcctcctgcaccttcagcacatccctgtgcacagctggaagggtgcatggcccgctcacctttgttcagatgggtggaaacgctgatgataccagctcctccctgccgtgcccctgccacggagcaggcattgtgaactggctggtgtttgcagtcccacgtggcatggcctccagcccaacccacagtggagactggagacagggcaatgagtctggtggggggcacgtggacatgccccataggggccccacccagacttaacaggcaaggtcctgggcattgcgcgacgcaggactcaatgctaaagcaagcctgcctggctctgtgccagggcccctcttctgattcacacatcccatttttacacagacccttccttcttaataaaggctgacagttctgttggcagccaagaacccacaccatgaagacagggagtgaggggcctttgtgcccaactccagcacagctgcgttctggggtgtgtgagaggcatgttcgtgtctgtgcgctggtggtctcgtgagacagttccgaggacggggaaattgcagggtggtgggggcgtgaggcttatatgtggaactgatgcagagttcgcctgcagacggatctggatatacactatgtataattgttacgtgtaatttaaaatatatctgtttgccatcgtcatgagaagattatatgtaaggctctgaagggagagggagatgtacattctgccaggctcctggggaccttatccgagtcatgaaattgattactgttgatccagtggtgcaagaagctacactccatgtgtcatcacgcttatgactcctaatgtatttttaaggcaaaaaatgtcagccgactccatcttcacccctcgattcctcgagtccagcctttctgtgccagtgcttcactgagccacaacgctctcgccatcgggacccggctgggcctggagtctcggggcacagttgccatggagccctcctgggtcattctacaaatgtgctgagtgccagctgaaaaccccacaggagatggagtaccttggccaagcttaaagagaagattttctcagggtatttattagtgtgtccagcagggtcaggaagcaggatggaaagatgcactcagactgttaatttattaacaaggcaaatgattttgtgtttcttgatgacagactattaagtttgggacttattttcccatttgagaagttataatatatatttaagatgataagtttcctgcttaagttgtgcctttcagcttcaatgagtttaaggagcactaagggtaatgataccaatgagggttggtttattatcaaacctgaatagctgtggtttctccagtaaatattttcttctactgaacatggagccattattaagagttgtgtgttttttattatgtacatttgtatatttttttgcttgtttgatgttctatttttctaatagttttcttttagtttcttaaagttgtgatactagatttagattctgatgctaactgcaaatcaggttggtctctgctgggtctctcctgcttttattttactttaaggacaagtgtagttgtcgtccaccacctttcaaaaaatgtgaaactgccctgcctcccctttttgctgacaacactgtgtacattgaccacttcctaccatactttatgttgtaaaatcaaactcttttgtggtacattatctcatgcttctgcaaattcgaataaattctatggcttccatgtg

SEQ ID NO: 29377 - DNA, 547 bp, Homo sapiens
gatgtggccagtggtgtggatgtgaatattcatccctgtggaggaaaatagtggggtctctgagatttgattctgaaaccttccttgtatccctcctgagacatctttgctgcaagatcgaggctgtcctctggtgagaaggtggtgaggcttcccgtcatattccagctctgaacagcaacatggggtgcaaagtcctgctcaacattgggcagcagatgctgcggcggaaggtggtggactgtagccgggaggagacgcggctgtctcgctgcctgaacacttttgatctggtggccctcggggtgggcagcacactgggtgctggtgtctacgtcctggctggagctgtggcccgtgagaatgcaggccctgccattgtcatctccttcctgatcgctgcgctggcctcagtgctggctggcctgtgctatggcgagtttggtgctcgggtccccaagacgggctcagcttacctctacagctatgtcaccgttggagagctctgggccttcatcaccggctggaacttaatcctctcctacat

SEQ ID NO: 29378 - DNA, 7560 bp, Homo sapiens
tcccaaaacagaaagagcagatgtctcaccacgaaactagcaactggaatgaagatagaaacaagtggttataactcagacaaactaatttgtcgagggtttattggaacacctgccccaccggtttgcgacagcaagtttctcctgtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttcttggatccattttcccaatgcctcgtgtaatctatgctatggcggaggatgggttgcttttcaaatgtctagctcaaatcaattccaaaacgaagacaccaataattgctactttatcatcgggtgcagtggcagctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaatttagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagacgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttctttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaatatgctttctgatgtggtgtatttttaaaataaattttaatatgt

SEQ ID NO: 29379 - DNA, 7557 bp, Homo sapiens
tcccaaaacagaaagagcagatgtctcaccacgaaactagcaactggaatgaagatagaaacaagtggttataactcagacaaactaatttgtcgagggtttattggaacacctgccccaccggtttgcgacagcaagtttctcctgtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttctgggctctatgtttcctttaccccgaattctgtttgccatggcccgggatggcttactgtttagatttcttgccagagtgagtaagaggcagtcaccagttgctgccacgttgactgcaggggtcatttctgctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaatttagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagacgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttctttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaatatgctttctgatgtggtgtatttttaaaataaattttaatatgt

SEQ ID NO: 29380 - DNA, 7638 bp, Homo sapiens
ggcgcgaccccaacccagccccacaggagactctctgaagaccagcaggaaagcagtgagcccttacagtcccaaaacagaaagagcagatgtctcaccacgaaactagcaactggaatgaagatagaaacaagtggttataactcagacaaactaatttgtcgagggtttattggaacacctgccccaccggtttgcgacagcaagtttctcctgtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttctgggctctatgtttcctttaccccgaattctgtttgccatggcccgggatggcttactgtttagatttcttgccagagtgagtaagaggcagtcaccagttgctgccacgttgactgcaggggtcatttctgctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaatttagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagacgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttctttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaatatgctttctgatgtggtgtatttttaaaataaattttaatatgtaataatatagaa

SEQ ID NO: 29381 - DNA, 7622 bp, Homo sapiens
ctccttctgcagcgcggccggcgggcgctcctcttcgcgggaccagcgaggcggcggccgctgctccagcgtcccccagccgcgggcccccgacgcgctgcagccggcagcccaccgccgccttcttggcgcgaccccaacccagccccacaggagactctctgaagaccagcaggaaagcagtgagcccttacaggtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttcttggatccattttcccaatgcctcgtgtaatctatgctatggcggaggatgggttgcttttcaaatgtctagctcaaatcaattccaaaacgaagacaccaataattgctactttatcatcgggtgcagtggcagctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaatttagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagacgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttctttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaatatgctttctgatgtggtgtatttttaaaataaattttaatatgtaataatatagaa

SEQ ID NO: 29382 - DNA, 2274 bp, Homo sapiens
cttctgcagcgcggccggcgggcgctcctcttcgcgggaccagcgaggcggcggccgctgctccagcgtcccccagccgcgggcccccgacgcgctgcagccggcagcccaccgccgccttcttggcgcgaccccaacccagccccagtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttcttggatccattttcccaatgcctcgtgtaatctatgctatggcggaggatgggttgcttttcaaatgtctagctcaaatcaattccaaaacgaagacaccaataattgctactttatcatcgggtgcagtggcagctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttata

SEQ ID NO: 29383 - DNA, 1752 bp, Homo sapiens
ggcacgggcggtcagctgggccgcagctcctccggctctgcagggtcacggaggaaggtaagtaagccagctcccctagtccaggccgagcttgcacttgcgtcttgtctgctgctgctgaaccaagatttagctgtgcgccctccttgcagtctcctggaaccagcaggaggaaacatgggggatactggcctgagaaagcggagagaggatgagaagtcgatccagagccaagagcctaagaccaccagtctccaaaaggagctgggcctcatcagtggcatctccatcatcgtgggcaccatcattggctctgggatcttcgtttcccccaagtctgtgctcagcaacacggaagctgtggggccctgcctcatcatatgggcggcttgcggggtcctcgcgacgctgggtgccctgtgctttgcggagcttggcacaatgatcaccaagtcagggggagagtatccctacctgatggaggcctacgggcccatccccgcctacctcttctcctgggccagcctgatcgtcattaagcccacgtccttcgccatcatctgcctcagcttctccgagtatgtgtgtgcgcccttctatgtgggctgcaagcctcctcaaatcgttgtgaaatgcctggccgccgccgccatcttgttcatctcgacagtgaactcactgagcgtgcggctgggaagctacgtccagaacatcttcaccgcggccaagctggtgatcgtggccatcatcatcatcagcgggctggtgctcctggcccaaggaaacacaaagaattttgataattctttcgagggcgcccagctgtctgtgggagccatcagcctggcgttttacaatggactctgggcctatgatggatggaatcaactcaattacatcacagaagaacttagaaacccttacagaaacctgcctttggccattatcatcgggatccccctggtgacggcgtgctacatcctcatgaacgtgtcctacttcaccgtgatgactgccaccgaactcctgcagtcccaggcggtggctgtgacatttggtgaccgtgttctctatcctgcttcttggatcgttccactttttgtggcattttcaaccatcggtgctgctaacgggacctgcttcacagcgggcagactcatttacgtggcgggccgggagggtcacatgctcaaagtgctttcttacatcagcgtcaggcgcctcactccagcccccgccatcatcttttatggtatcatagcaacgatttatatcatccctggtgacataaactcgttagtcaattatttcagctttgccgcatggctgttttatggcctgacgattctaggactcatcgtgatgagatttacaaggaaagagctggaaaggcctatcaaggtgcccgtagtcattcccgtcttgatgacactcatctctgtgtttttggttctggctccaatcatcagcaagcccacctgggagtacctctactgtgtgctgtttatattaagcggccttttattttacttcctgtttgtccactacaagtttggatgggctcagaaaatctcaaagccgattaccatgcaccttcagatgctaatggaagtggtcccaccggaggaagaccctgagtaacaagctccgtctcttgtagccaagtcagctgaatttattttcttaagcaatatttgtggttatttcttcctttttttcttacgaataaaatatactcagatgtttaaaata

SEQ ID NO: 29384 - DNA, 1772 bp, Homo sapiens
acaagacatggccatttctagggttggaccgtgcaggcacgggcggtcagctgggccgcagctcctccggctctgcagggtcacggaggaagccagctcccctagtccaggccgagcttgcacttgcgtcttgtctgctgctgctgaaccaagatttagctgtgcgccctccttgcagtctcctggaaccagcaggaggaaacatgggggatactggcctgagaaagcggagagaggatgagaagtcgatccagagccaagagcctaagaccaccagtctccaaaaggagctgggcctcatcagtggcatctccatcatcgtgggcaccatcattggctctgggatcttcgtttcccccaagtctgtgctcagcaacacggaagctgtggggccctgcctcatcatatgggcggcttgcggggtcctcgcgacgctgggtgccctgtgctttgcggagcttggcacaatgatcaccaagtcagggggagagtatccctacctgatggaggcctacgggcccatccccgcctacctcttctcctgggccagcctgatcgtcattaagcccacgtccttcgccatcatctgcctcagcttctccgagtatgtgtgtgcgcccttctatgtgggctgcaagcctcctcaaatcgttgtgaaatgcctggccgccgccgccatcttgttcatctcgacagtgaactcactgagcgtgcggctgggaagctacgtccagaacatcttcaccgcggccaagctggtgatcgtggccatcatcatcatcagcgggctggtgctcctggcccaaggaaacacaaagaattttgataattctttcgagggcgcccagctgtctgtgggagccatcagcctggcgttttacaatggactctgggcctatgatggatggaatcaactcaattacatcacagaagaacttagaaacccttacagaaacctgcctttggccattatcatcgggatccccctggtgacggcgtgctacatcctcatgaacgtgtcctacttcaccgtgatgactgccaccgaactcctgcagtcccaggcggtggctgtgacatttggtgaccgtgttctctatcctgcttcttggatcgttccactttttgtggcattttcaaccatcggtgctgctaacgggacctgcttcacagcgggcagactcatttacgtggcgggccgggagggtcacatgctcaaagtgctttcttacatcagcgtcaggcgcctcactccagcccccgccatcatcttttatggtatcatagcaacgatttatatcatccctggtgacataaactcgttagtcaattatttcagctttgccgcatggctgttttatggcctgacgattctaggactcatcgtgatgagatttacaaggaaagagctggaaaggcctatcaaggtgcccgtagtcattcccgtcttgatgacactcatctctgtgtttttggttctggctccaatcatcagcaagcccacctgggagtacctctactgtgtgctgtttatattaagcggccttttattttacttcctgtttgtccactacaagtttggatgggctcagaaaatctcaaagccgattaccatgcaccttcagatgctaatggaagtggtcccaccggaggaagaccctgagtaacaagctccgtctcttgtagccaagtcagctgaatttattttcttaagcaatatttgtggttatttcttcctttttttcttacgaataaaatatactcagatgttt

SEQ ID NO: 29385 - DNA, 2313 bp, Homo sapiens
gcggaggcagcggctgcggcagcagcaggttccagtagctggctcggtgctcttctcggccacctgccatggcccgggggctgcccaccattgctagcctggcacgcttatgccagaagctgaaccgcctgaagccgctggaggactccaccatggagacgtcactgcggcgctgcctgtccacgctggacctgactcttctgggcgtgggtggcatggtgggctcgggtctctacgtgctcacaggtgccgtggccaaggaggtggctggccctgctgtgctcttgtccttcggtgtggccgctgtggcctccctgctggcagccctatgctatgcagaatttggggcacgtgtgccacgcacgggctctgcctacctgttcacctacgtatccatgggcgagctgtgggccttcctcatcggctggaatgttctcctcgaatacatcatcggtggcgccgccgtggcccgtgcctggagtggctacctggactctatgttcagccacagcatccgcaacttcactgagacccacgtgggttcttggcaggtgcccctcctgggccactacccggacttcctggctgctggcatcatcctcctggcctctgcctttgtctcctgtggagcccgcgtgtcctcctggctcaatcacaccttctcggccatcagcctgcttgtcattctcttcattgtcatcctgggcttcatcctggcccagcctcacaactggagcgctgacgaaggcggctttgcacccttcggcttctccggcgtcatggccggcactgcctcctgcttctatgctttcgtgggcttcgacgtcattgccgcctccagtgaggaggcccagaacccacggcggtctgtgcctctggccatcgccatctcgcttgccattgcagctggtgcctacatccttgtctccaccgtgctaaccctcatggtgccctggcacagcctggaccccgactcagcgcttgcagatgccttctaccagcggggctacaggtgggctggcttcatcgtggcagctggctccatctgcgccatgaacaccgtcctgctcagcctcctcttctccctgccacgcattgtctatgccatggccgccgatgggctcttcttccaggtgtttgcccatgtgcacccccggacacaggtgcctgtggcgggcaccctggcgttcgggctcctcacggccttcctggcactgctgctggacctggagtcgctggttcagttcctgtcccttggcacactcctggcctacacattcgtggccaccagtatcattgtgctgcgcttccagaagtcttccccgcccagctccccaggcccagccagccctggccccctgaccaagcagcagagctccttctcagaccacctacagctggtgggcactgtacacgcctccgtccctgagccaggggagctgaagccagccctgaggccctacctgggcttcttggatgggtacagccctggagcagtggtgacttgggcgcttggcgttatgttggcctcagccatcaccataggctgcgtgcttgtctttgggaactcgaccctgcacctcccacactggggttacatcctgctgctcctgctcaccagtgtcatgtttctgctcagcctccttgtcctgggggctcaccagcaacagtatcgggaagacttatttcagatccccatggttcccctgattccagccctgagcatcgtcctcaacatctgcctcatgctgaaacttagctatctgacctgggtgcgcttctccatctggctgctgatgggacttgcagtgtatttcggctatggcatccggcatagcaaggagaaccagcgggagctgccagggctgaactccacacactacgtggtattccccaggggcagcctggaggagacagtgcaggctatgcagccccccagccaggcaccagcacaggaccctggccatatggagtagctgatcagcccacacttgccccgccctcccacacctgcttgggaggccagagaggccagacaagccgagagccccttctgttgtgggcagcctgggtttgcaggcctgcacaggctggggagtcctcaggaccttaggaccttcatccaggggctgggcttcgggtcttcaggagtgggccttggctggtgctggtgccatggactctgcccagagccttcttgtttatgatcagctccagctacctgggcagttgtggtggggtggatgggaaggcccacagcccaagggatccataataataattgcttggccagccatgtggcctgctggcgta

SEQ ID NO: 29386 - DNA, 2307 bp, Homo sapiens
gcggctgcggcagcagcagcaggttccagtagctggctcggtgctcttctcggccacctgccatggcccgggggctgcccaccattgctagcctggcacgcttatgccagaagctgaaccgcctgaagccgctggaggactccaccatggagacgtcactgcggcgctgcctgtccacgctggacctgactcttctgggcgtgggtggcatggtgggctcgggtctctacgtgctcacaggtgccgtggccaaggaggtggctggccctgctgtgctcttgtccttcggtgtggccgctgtggcctccctgctggcagccctatgctatgcagaatttggggcacgtgtgccacgcacgggctctgcctacctgttcacctacgtatccatgggcgagctgtgggccttcctcatcggctggaatgttctcctcgaatacatcatcggtggcgccgccgtggcccgtgcctggagtggctacctggactctatgttcagccacagcatccgcaacttcactgagacccacgtgggttcttggcaggtgcccctcctgggccactacccggacttcctggctgctggcatcatcctcctggcctctgcctttgtctcctgtggagcccgcgtgtcctcctggctcaatcacaccttctcggccatcagcctgcttgtcattctcttcattgtcatcctgggcttcatcctggcccagcctcacaactggagcgctgacgaaggcggctttgcacccttcggcttctccggcgtcatggccggcactgcctcctgcttctatgctttcgtgggcttcgacgtcattgccgcctccagtgaggaggcccagaacccacggcggtctgtgcctctggccatcgccatctcgcttgccattgcagctggtgcctacatccttgtctccaccgtgctaaccctcatggtgccctggcacagcctggaccccgactcagcgcttgcagatgccttctaccagcggggctacaggtgggctggcttcatcgtggcagctggctccatctgcgccatgaacaccgtcctgctcagcctcctcttctccctgccacgcattgtctatgccatggccgccgatgggctcttcttccaggtgtttgcccatgtgcacccccggacacaggtgcctgtggcgggcaccctggcgttcgggctcctcacggccttcctggcactgctgctggacctggagtcgctggttcagttcctgtcccttggcacactcctggcctacacattcgtggccaccagtatcattgtgctgcgcttccagaagtcttccccgcccagctccccaggcccagccagccctggccccctgaccaagcagcagagctccttctcagaccacctacagctggtgggcactgtacacgcctccgtccctgagccaggggagctgaagccagccctgaggccctacctgggcttcttggatgggtacagccctggagcagtggtgacttgggcgcttggcgttatgttggcctcagccatcaccataggctgcgtgcttgtctttgggaactcgaccctgcacctcccacactggggttacatcctgctgctcctgctcaccagtgtcatgtttctgctcagcctccttgtcctgggggctcaccagcaacagtatcgggaagacttatttcagatccccatggttcccctgattccagccctgagcatcgtcctcaacatctgcctcatgctgaaacttagctatctgacctgggtgcgcttctccatctggctgctgatgggacttgcagtgtatttcggctatggcatccggcatagcaaggagaaccagcgggagctgccagggctgaactccacacactacgtggtattccccaggggcagcctggaggagacagtgcaggctatgcagccccccagccaggcaccagcacaggaccctggccatatggagtagctgatcagcccacacttgccccgccctcccacacctgcttgggaggccagagaggccagacaagccgagagccccttctgttgtgggcagcctgggtttgcaggcctgcacaggctggggagtcctcaggaccttaggaccttcatccaggggctgggcttcgggtcttcaggagtgggccttggctggtgctggtgccatggactctgcccagagccttcttgtttatgatcagctccagctacctgggcagttgtggtggggtggatgggaaggcccacagcccaagggatccataataataattgcttggccagccatgtggcctgctggcgta

SEQ ID NO: 29387 - DNA, 416 bp, Homo sapiens
agaaggtgggctgcggactttcagacgtggcccttaacctccccgaactgacctaggctagtcagtcagccggcggtctgaccttctccatctgtgactgagtcacagtcacagggcttccctagaccccggttccagtagctggctcggtgctcttctcggccacctgccatggcccgggggctgcccaccattgctagcctggcacgcttatgccagaagctgaaccgcctgaagccgctggaggactccaccatggagacgtcactgcggcgctgcctgtccacgctggacctgactcttctgggcgtgggtggcatggtgggctcgggtctctacgtgctcacaggtgccgtggccaaggaggtggctggccctgctgtgctcttgtccttcggtgtggccgctgtggcctc

SEQ ID NO: 29388 - DNA, 2922 bp, Homo sapiens
atgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtcaaaacaatatcagtcaaggtaattgatgatgaggagtatgagaaaaacaagaccttcttccttgagattggagagccccgcctggtggagatgagtgagaagaaagccctgttattgaatgagcttggtggcttcacaataacaggaaaatacctgtttggccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaa

SEQ ID NO: 29389 - DNA, 6053 bp, Homo sapiens
taggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtcaaaacaatatcagtcaaggtaattgatgatgaggagtatgagaaaaacaagaccttcttccttgagattggagagccccgcctggtggagatgagtgagaagaaagccctgttattgaatgagcttggtggcttcacaataacaggaaaatacctgtttggccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgcagctcagtctagaagggctgcactctctccaggttgataaatccttaaggctttgatttgttttgtttttggttttgttttcagtggagctggggaggtagttaatgtttggctttatttttgttattttgttttgttttgtttttttgggagagtcagggttgttgcttttctttgtggaaagtgaaaccatccaaatgtaaatgggttttggtaaaaatttaaatcattagtattccccctcacctcccccaatcactttaaaacttattttggattaagaaaaaatctgggcatggaagaagaaagaagcatgtcttcatcgtattaccaaagttcatgcttatctccggaatgtgagtggaggtgaagctgcctccaagaagaagcataaaagtggaatggagccaggaaatccgatggttctagaaatagtctgatatttaaacatgtgatacctggcagtctcgtttaacaggtacaaggaaaacgtgcctagattcccaggaacgtgcaaaatcctttctttcttatctctttagctctggactgtgattggcaaggtccttcttccagcattcagcccagctaagcccccaggtgccccatcccaaccctgttcctcctgtccacctgccatcccctatgcaaacagtaagaataaccccattcaaaaagcacatcatcgttttccatttgcattaacatgtgtctcagtcccatgttgccgttgcttgggattgtctgtcagttttattttcaaaggcatccatggcttgcacaatcctgttccagtcatgactgaacatttgctccttcttcatgtgccgttcggaaatgttgttgtgatacctgttacacagtgcatggtgaaaaacaaataaaacaaaacaaagagtatctgtatatagtagagtatagtacatactgttctcccatttggcaatgttgattggacattgaagacataagtgagttttcttttcacctgagttgttacttttgtgctgttattgagtttgattaattactagggataaaaggagaaaatggattattgttcacggttctgcacattcatttctaagaagcaataactgtcatgtggggagaagttaaagctattgagaggatagcaggcaaactacaaagatcttcatggaaaattagccatgtggaacacatcagaggcctctaaaaatcacccattaattcaggaaggccaaggagaaaggccttatagagacgttgatatgttggatgtgcctaggctttcagagccaccctttccacaacacccctccctgcaaagtatttatttcacatctgcactgtctggcacagatggtagatagtgctggtttgttcattttatttttttacttaaaaggctattttgagccctgtttctttcactgtccagtctagtcctctttgattatatcagtagttgctgagtaagaaagaagccagggtgaccaacgggcctttaaaagtgttgtctcctctacttatgctgaaagagaaggcaattaaataagactagtacctcccaggaggattggactgggatatttttaaccctttaaaaagaatagctgtttctatgttaaaataccaaagaacatggataaacccaacattccaaagtagtgagtccactaatgagaaaaataatagaatgactttggtcacctctcggagacttctgtgtctataaggaatcccaggctggagacattcctagccctctgtattgattcaaaaatacttaataaattaaagctgttgagacttattttttcttctgtcactcagtaaccatgatccttcctcatttaataaacatttggtgactgaatgagtaattaaatgctggttacccacttaatgtgccaggtagtatgatactttctggggactaagccatgaacaaaacagtctagatccctgccctcagaagggttacagtttatgtgattactattttcatgagtaaaagtgaagaaagccatatggaaagatttttatcttgcaagaaaaaacaattatgaaactcttttaacataaacacactgaaactgtatcaaagcaattgtccaaattgtatttatacccaagaatttctttaactaagagagcataaggcatatgtttggaaaaccaccctctttatctttgaccgacttgcagataaatatatctctccattttaaaccaagaagggcaatcatgttggtgatccagatcactgagaaagcccagtgtatcccatcttttatctttgttggcaatggaacttttctatggcccacactttacaattctttgtcattctaacccatccttcccatccttattttttttttttttgagaattgctaaatggaaagctagcctagaagcaccaagtaaatatattcaaggaatataagttgtttaaacattagaaaaatttttgcactcattttttagctgtattaggaatgtcaataatcctgtagcaaattttcacagagaactttaagaaattcttgcattggtcgatttcaatttgaaagctttttggtttgtttgctttttaaattttcatgttctaggaaactatgattctggttgttcaggattgttattattatagttgtgtaaaattattttattttgtgtgtattgtgcacagcttggggggggggcgggaaatgcactaattgtgctcttccttataaatggtacatattactgacacagacaaataaagtttctaattgtttctgatttaatcactagtgatacagcatattctgtatgaaatgttttctcctttctcattgtcatctacttcattttttgttttcatgttttgaagaaataaaaaccaaaatggta

SEQ ID NO: 29390 - DNA, 3065 bp, Homo sapiens
ctttctggtaaatttagagaaggcatcatactgggatcttttttcacatccagcccatgcggactgagcagccaaagcttgacagagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtggcttcacaataacagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactag

SEQ ID NO: 29391 - DNA, 3178 bp, Homo sapiens
aagcttgacagaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtcaaaacaatatcagtcaaggtaattgatgatgaggagtatgagaaaaacaagaccttcttccttgagattggagagccccgcctggtggagatgagtgagaagaaagccctgttattgaatgagcttggtggcttcacaataacaggaaaatacctgtttggccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgca

SEQ ID NO: 29392 - DNA, 2965 bp, Homo sapiens
tcttggttgctctcaccatgtgatacaccagctccacctttgccttctgctgtgactgtaagtttcctgaggcctctccagaagcagattctagcaccatgctgctcgcacagccttcaaaacttaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtggcttcacaataacagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaagg

SEQ ID NO: 29393 - DNA, 3139 bp, Homo sapiens
taggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtcaaaacaatatcagtcaaggtaattgatgatgaggagtatgagaaaaacaagaccttcttccttgagattggagagccccgcctggtggagatgagtgagaagaaagccctgttattgaatgagcttggtggcttcacaataacaggccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggca

SEQ ID NO: 29394 - DNA, 2814 bp, Homo sapiens
atgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtggcttcacaataacagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaa

SEQ ID NO: 29395 - DNA, 6111 bp, Homo sapiens
ggcgctgcacggtagtcagcccgccgccgccgcctgctttgtgcttcccacagaagatgggagcgacctcttcctgatcgggagctgtttaaaaggagggagtgcgccgtattttctactagcgtggaggaacggaggaagaatccattcacactccccaaaccagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtggcttcacaataacagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgcagctcagtctagaagggctgcactctctccaggttgataaatccttaaggctttgatttgttttgtttttggttttgttttcagtggagctggggaggtagttaatgtttggctttatttttgttattttgttttgttttgtttttttgggagagtcagggttgttgcttttctttgtggaaagtgaaaccatccaaatgtaaatgggttttggtaaaaatttaaatcattagtattccccctcacctcccccaatcactttaaaacttattttggattaagaaaaaatctgggcatggaagaagaaagaagcatgtcttcatcgtattaccaaagttcatgcttatctccggaatgtgagtggaggtgaagctgcctccaagaagaagcataaaagtggaatggagccaggaaatccgatggttctagaaatagtctgatatttaaacatgtgatacctggcagtctcgtttaacaggtacaaggaaaacgtgcctagattcccaggaacgtgcaaaatcctttctttcttatctctttagctctggactgtgattggcaaggtccttcttccagcattcagcccagctaagcccccaggtgccccatcccaaccctgttcctcctgtccacctgccatcccctatgcaaacagtaagaataaccccattcaaaaagcacatcatcgttttccatttgcattaacatgtgtctcagtcccatgttgccgttgcttgggattgtctgtcagttttattttcaaaggcatccatggcttgcacaatcctgttccagtcatgactgaacatttgctccttcttcatgtgccgttcggaaatgttgttgtgatacctgttacacagtgcatggtgaaaaacaaataaaacaaaacaaagagtatctgtatatagtagagtatagtacatactgttctcccatttggcaatgttgattggacattgaagacataagtgagttttcttttcacctgagttgttacttttgtgctgttattgagtttgattaattactagggataaaaggagaaaatggattattgttcacggttctgcacattcatttctaagaagcaataactgtcatgtggggagaagttaaagctattgagaggatagcaggcaaactacaaagatcttcatggaaaattagccatgtggaacacatcagaggcctctaaaaatcacccattaattcaggaaggccaaggagaaaggccttatagagacgttgatatgttggatgtgcctaggctttcagagccaccctttccacaacacccctccctgcaaagtatttatttcacatctgcactgtctggcacagatggtagatagtgctggtttgttcattttatttttttacttaaaaggctattttgagccctgtttctttcactgtccagtctagtcctctttgattatatcagtagttgctgagtaagaaagaagccagggtgaccaacgggcctttaaaagtgttgtctcctctacttatgctgaaagagaaggcaattaaataagactagtacctcccaggaggattggactgggatatttttaaccctttaaaaagaatagctgtttctatgttaaaataccaaagaacatggataaacccaacattccaaagtagtgagtccactaatgagaaaaataatagaatgactttggtcacctctcggagacttctgtgtctataaggaatcccaggctggagacattcctagccctctgtattgattcaaaaatacttaataaattaaagctgttgagacttattttttcttctgtcactcagtaaccatgatccttcctcatttaataaacatttggtgactgaatgagtaattaaatgctggttacccacttaatgtgccaggtagtatgatactttctggggactaagccatgaacaaaacagtctagatccctgccctcagaagggttacagtttatgtgattactattttcatgagtaaaagtgaagaaagccatatggaaagatttttatcttgcaagaaaaaacaattatgaaactcttttaacataaacacactgaaactgtatcaaagcaattgtccaaattgtatttatacccaagaatttctttaactaagagagcataaggcatatgtttggaaaaccaccctctttatctttgaccgacttgcagataaatatatctctccattttaaaccaagaagggcaatcatgttggtgatccagatcactgagaaagcccagtgtatcccatcttttatctttgttggcaatggaacttttctatggcccacactttacaattctttgtcattctaacccatccttcccatccttattttttttttttttgagaattgctaaatggaaagctagcctagaagcaccaagtaaatatattcaaggaatataagttgtttaaacattagaaaaatttttgcactcattttttagctgtattaggaatgtcaataatcctgtagcaaattttcacagagaactttaagaaattcttgcattggtcgatttcaatttgaaagctttttggtttgtttgctttttaaattttcatgttctaggaaactatgattctggttgttcaggattgttattattatagttgtgtaaaattattttattttgtgtgtattgtgcacagcttggggggggggcgggaaatgcactaattgtgctcttccttataaatggtacatattactgacacagacaaataaagtttctaattgtttctgatttaatcactagtgatacagcatattctgtatgaaatgttttctcctttctcattgtcatctacttcattttttgttttcatgttttgaagaaataaaaaccaaaatggta

SEQ ID NO: 29396 - DNA, 3434 bp, Homo sapiens
atgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtcaaaacaatatcagtcaaggtaattgatgatgaggagtatgagaaaaacaagaccttcttccttgagattggagagccccgcctggtggagatgagtgagaagaaaggaagatcattaccattagaatatttgaccgtgaggaatatgagaaagagtgcagtttctcccttgtgcttgaggaaccaaaatggataagaagaggaatgaaaggtggcttcacaataacagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgcagctcagtctagaagggctgcactctctccaggttgataaatccttaaggctttgatttgttttgtttttggttttgttttcagtggagctggggaggtagttaatgtttggctttatttttgttattttgttttgttttgtttttttgggagagtcagggttgttgcttttctttgtggaaagtgaaaccatccaaatgtaaatgggttttggtaaaaatttaaatcattagtattccccctcacctcccccaatcactttaaaacttattttggattaagaaaaaatctgggcatggaa

SEQ ID NO: 29397 - DNA, 2898 bp, Homo sapiens
atgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaaggtggcttcacaataacaggaaaatacctgtttggccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaa

SEQ ID NO: 29398 - DNA, 583 bp, Homo sapiens
agcgacctcttcctgatcgggagctgtttaaaaggagggagtgcgccgtattttctactagcgtggaggaacggaggaagaatccattcacactccccaaaccagggatgtcatggtctagaacacctatgctgaagtacaaggctgagcaagaaagatcactccactgcaactgagcaaagtgctgaaggagttgaaaggaagaagagaacattggacgtggtttcacggaggaggaagcattttaatttattcagaaagagtgaaaaggattttgaaagcaaataaggctagccacttttgaaacatgtcaaagagccccagcttatttacgacaagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggaca

SEQ ID NO: 29399 - DNA, 561 bp, Homo sapiens
ctttctggtaaatttagagaaggcatcatactgggatcttttttcacatccagcccatgcggactgagcagccaaagcttgacagaggtccctccttctcccaccttccccaagtagctgctcctgacccccccacacaccttggcaaacgacaccagtggccgatagcaactggtgttttaaaaatactaatttggagccccatttgagacctacaacgggagagtctgcatcagattcggcctcagattctacagcatctgactacattcccagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctac

SEQ ID NO: 29400 - DNA, 563 bp, Homo sapiens
atcagtcgtggtgactgccctggttgcactgtaagtatggggggacgtctccacgaaaaaaaactaactttctgccttgtgctctgcaggtccctccttctcccaccttccccaagtagctgctcctgacccccccacacaccttggcaaacgacaccagtggccgatagcaactggtgttttaaaaatactaatttggagccccatttgagacctacaacgggagagtctgcatcagattcggcctcagattctacagcatctgactacattcccagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctac

SEQ ID NO: 29401 - DNA, 2883 bp, Homo sapiens
atgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaagaaggattctggttatctagccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaa

SEQ ID NO: 29402 - DNA, 2814 bp, Homo sapiens
atgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtgaagatcattaccattagaatatttgaccgtgaggaatatgagaaagagtgcagtttctcccttgtgcttgaggaaccaaaatggataagaagaggaatgaaagaaggattctgtttcacagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaa

SEQ ID NO: 29403 - DNA, 4597 bp, Homo sapiens
ctttctggtaaatttagagaaggcatcatactgggatcttttttcacatccagcccatgcggactgagcagccaaagcttgacagagtaggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgacctgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactatgatatatattaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgcagctcagtctagaagggctgcactctctccaggttgataaatccttaaggctttgatttgttttgtttttggttttgttttcagtggagctggggaggtagttaatgtttggctttatttttgttattttgttttgttttgtttttttgggagagtcagggttgttgcttttctttgtggaaagtgaaaccatccaaatgtaaatgggttttggtaaaaatttaaatcattagtattccccctcacctcccccaatcactttaaaacttattttggattaagaaaaaatctgggcatggaagaagaaagaagcatgtcttcatcgtattaccaaagttcatgcttatctccggaatgtgagtggaggtgaagctgcctccaagaagaagcataaaagtggaatggagccaggaaatccgatggttctagaaatagtctgatatttaaacatgtgatacctggcagtctcgtttaacaggtacaaggaaaacgtgcctagattcccaggaacgtgcaaaatcctttctttcttatctctttagctctggactgtgattggcaaggtccttcttccagcattcagcccagctaagcccccaggtgccccatcccaaccctgttcctcctgtccacctgccatcccctatgcaaacagtaagaataaccccattcaaaaagcacatcatcgttttccatttgcattaacatgtgtctcagtcccatgttgccgttgcttgggattgtctgtcagttttattttcaaaggcatccatggcttgcacaatcctgttccagtcatgactgaacatttgctccttcttcatgtgccgttcggaaatgttgttgtgatacctgttacacagtgcatggtgaaaaacaaataaaacaaaacaaagagtatctgtatatagtagagtatagtacatactgttctcccatttggcaatgttgattggacattgaagacataagtgagttttcttttcacctgagttgttacttttgtgctgttattgagtttgattaattactagggataaaaggagaaaatggattattgttcacggttctgcacattcatttctaagaagcaataactgtcatgtggggagaagttaaagctattgagaggatagcaggcaaactacaaagatcttcatggaaaattagccatgtggaacacatcagaggcctctaaaaatcacccattaattcaggaaggccaaggagaaaggccttatagagacgttgatatgttggatgtgcctaggctttcagagccaccctttccacaacacccctccctgcaaagtatttatttcacatctgcactgtctggcacagatggtagatagtgctggtttgttcattttatttttttacttaaaaggctattttgagccctgtttctttcactgtccagtctagtcctctttgattatatcagtagttgctgagtaagaaagaagccagggtgaccaacgggcctttaaaagtgttgtctcctctacttatgctgaaagagaaggcaattaaataagactagtacctcccaggaggattggactgggatatttttaaccctttaaaaagaatagctgtttctatgttaaaataccaaagaacatggataaacccaacattccaaagtagtgagtccactaatgagaaaaataatagaatgactttggtcacctctcggagacttctgtgtctataaggaatcccaggctggagacattcctagccctctgtattgattcaaaaatacttaataaattaaagctgttgagacttattttttcttctgtcactcagtaaccatgatccttcctcatttaataaacatttggtgactgaatgagtaattaaatgctggttacccacttaatgtgccaggtagtatgatactttctggggactaagccatgaacaaaacagtctagatccctgccctcagaagggttacagtttatgtgattactattttcatgagtaaaagtgaagaaagccatatggaaagatttttatcttgcaagaaaaaacaattatgaaactcttttaacataaacacactgaaactgtatcaaagcaattgtccaaattgtatttatacccaagaatttctttaactaagagagcataaggcatatgtttggaaaaccaccctctttatctttgaccgacttgcagataaatatatctctccattttaaaccaagaagggcaatcatgttggtgatccagatcactgagaaagcccagtgtatcccatcttttatctttgttggcaatggaacttttctatggcccacactttacaattctttgtcattctaacccatccttcccatccttattttttttttttttgagaattgctaaatggaaagctagcctagaagcaccaagtaaatatattcaaggaatataagttgtttaaacattagaaaaatttttgcactcattttttagctgtattaggaatgtcaataatcctgtagcaaattttcacagagaactttaagaaattcttgcattggtcgatttcaatttgaaagctttttggtttgtttgctttttaaattttcatgttctaggaaactatgattctggttgttcaggattgttattattatagttgtgtaaaattattttattttgtgtgtattgtgcacagcttggggggggggcgggaaatgcactaattgtgctcttccttataaatggtacatattactgacacagacaaataaagtttctaattgtttctgatttaatcactagtgatacagcatattctgtatgaaatgttttctcctttctcattgtcatctacttcattttttgttttcatgttttgaagaaataaaaaccaaaatgg

SEQ ID NO: 29404 - DNA, 6038 bp, Homo sapiens
taggttgtgacagttggaagtgtcatgtacaacatgcggcgattaagtctttcacccaccttttcaatgggatttcatctgttagttactgtgagtctcttattttcccatgtggaccatgtaattgctgagacagaaatggaaggagaaggaaatgaaactggtgaatgtactggatcatattactgtaagaaaggggtgattttgcccatttgggaaccccaagacccttcttttggggacaaaattgctagagctactgtgtattttgtggccatggtctacatgtttcttggagtctctatcatagctgatcggttcatgtcctctatagaagtcatcacatctcaagaaaaagaaataaccataaagaaacccaatggagagaccaccaagacaactgtgaggatctggaatgaaacagtttctaacctgaccttgatggccctgggatcttctgctcctgagattctcctttcagtaattgaagtgtgtggccataacttcactgcaggagacctcggtcctagcaccatcgtgggaagtgctgcattcaatatgttcatcattattgcactctgtgtttatgtggtgcctgacggagagacaaggaagattaagcatttgcgtgtcttctttgtgacagcagcctggagcatctttgcctacacctggctttacattattttgtctgtcatatctcctggtgttgtggaggtctgggaaggtttgcttactttcttcttctttcccatctgtgttgtgttcgcttgggtagcggataggagacttctgttttacaagtatgtctacaagaggtatcgagctggcaagcagagggggatgattattgaacatgaaggagacaggccatcttctaagactgaaattgaaatggacgggaaagtggtcaattctcatgttgaaaatttcttagatggtgctctggttctggaggtggatgagagggaccaagatgatgaagaagctaggcgagaaatggctaggattctgaaggaacttaagcagaagcatccagataaagaaatagagcaattaatagaattagctaactaccaagtcctaagtcagcagcaaaaaagtagagcattttatcgcattcaagctactcgcctcatgactggagctggcaacattttaaagaggcatgcagctgaccaagcaaggaaggctgtcagcatgcacgaggtcaacactgaagtgactgaaaatgaccctgttagtaagatcttctttgaacaagggacatatcagtgtctggagaactgtggtactgtggcccttaccattatccgcagaggtggtgatttgactaacactgtgtttgttgacttcagaacagaggatggcacagcaaatgctgggtctgattatgaatttactgaaggaactgtggtgtttaagcctggtgatacccagaaggaaatcagagtgggtatcatagatgatgatatctttgaggaggatgaaaatttccttgtgcatctcagcaatgtcaaagtatcttctgaagcttcagaagatggcatactggaagccaatcatgtttctacacttgcttgcctcggatctccctccactgccactgtaactatttttgatgatgaccacgcaggcatttttacttttgaggaacctgtgactcatgtgagtgagagcattggcatcatggaggtgaaagtattgagaacatctggagctcgaggaaatgttatcgttccatataaaaccatcgaagggactgccagaggtggaggggaggattttgaggacacttgtggagagctcgaattccagaatgatgaaattgtcaaaacaatatcagtcaaggtaattgatgatgaggagtatgagaaaaacaagaccttcttccttgagattggagagccccgcctggtggagatgagtgagaagaaagccctgttattgaatgagcttggtggcttcacaataacaggccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaaaggaactatcagatatagtaaatttatatatatacatatatatacataaaaattatgtataatggacagaggaaactgacatttgtcatgttcacttacctgctgatggaatccagcttcaagagcatactctgtactagggccgaagtaaaaaaccatcacctcccattcccaggggcatcatcatgttcaacaaggcatggaggcagggccatctttgcagctcagtctagaagggctgcactctctccaggttgataaatccttaaggctttgatttgttttgtttttggttttgttttcagtggagctggggaggtagttaatgtttggctttatttttgttattttgttttgttttgtttttttgggagagtcagggttgttgcttttctttgtggaaagtgaaaccatccaaatgtaaatgggttttggtaaaaatttaaatcattagtattccccctcacctcccccaatcactttaaaacttattttggattaagaaaaaatctgggcatggaagaagaaagaagcatgtcttcatcgtattaccaaagttcatgcttatctccggaatgtgagtggaggtgaagctgcctccaagaagaagcataaaagtggaatggagccaggaaatccgatggttctagaaatagtctgatatttaaacatgtgatacctggcagtctcgtttaacaggtacaaggaaaacgtgcctagattcccaggaacgtgcaaaatcctttctttcttatctctttagctctggactgtgattggcaaggtccttcttccagcattcagcccagctaagcccccaggtgccccatcccaaccctgttcctcctgtccacctgccatcccctatgcaaacagtaagaataaccccattcaaaaagcacatcatcgttttccatttgcattaacatgtgtctcagtcccatgttgccgttgcttgggattgtctgtcagttttattttcaaaggcatccatggcttgcacaatcctgttccagtcatgactgaacatttgctccttcttcatgtgccgttcggaaatgttgttgtgatacctgttacacagtgcatggtgaaaaacaaataaaacaaaacaaagagtatctgtatatagtagagtatagtacatactgttctcccatttggcaatgttgattggacattgaagacataagtgagttttcttttcacctgagttgttacttttgtgctgttattgagtttgattaattactagggataaaaggagaaaatggattattgttcacggttctgcacattcatttctaagaagcaataactgtcatgtggggagaagttaaagctattgagaggatagcaggcaaactacaaagatcttcatggaaaattagccatgtggaacacatcagaggcctctaaaaatcacccattaattcaggaaggccaaggagaaaggccttatagagacgttgatatgttggatgtgcctaggctttcagagccaccctttccacaacacccctccctgcaaagtatttatttcacatctgcactgtctggcacagatggtagatagtgctggtttgttcattttatttttttacttaaaaggctattttgagccctgtttctttcactgtccagtctagtcctctttgattatatcagtagttgctgagtaagaaagaagccagggtgaccaacgggcctttaaaagtgttgtctcctctacttatgctgaaagagaaggcaattaaataagactagtacctcccaggaggattggactgggatatttttaaccctttaaaaagaatagctgtttctatgttaaaataccaaagaacatggataaacccaacattccaaagtagtgagtccactaatgagaaaaataatagaatgactttggtcacctctcggagacttctgtgtctataaggaatcccaggctggagacattcctagccctctgtattgattcaaaaatacttaataaattaaagctgttgagacttattttttcttctgtcactcagtaaccatgatccttcctcatttaataaacatttggtgactgaatgagtaattaaatgctggttacccacttaatgtgccaggtagtatgatactttctggggactaagccatgaacaaaacagtctagatccctgccctcagaagggttacagtttatgtgattactattttcatgagtaaaagtgaagaaagccatatggaaagatttttatcttgcaagaaaaaacaattatgaaactcttttaacataaacacactgaaactgtatcaaagcaattgtccaaattgtatttatacccaagaatttctttaactaagagagcataaggcatatgtttggaaaaccaccctctttatctttgaccgacttgcagataaatatatctctccattttaaaccaagaagggcaatcatgttggtgatccagatcactgagaaagcccagtgtatcccatcttttatctttgttggcaatggaacttttctatggcccacactttacaattctttgtcattctaacccatccttcccatccttattttttttttttttgagaattgctaaatggaaagctagcctagaagcaccaagtaaatatattcaaggaatataagttgtttaaacattagaaaaatttttgcactcattttttagctgtattaggaatgtcaataatcctgtagcaaattttcacagagaactttaagaaattcttgcattggtcgatttcaatttgaaagctttttggtttgtttgctttttaaattttcatgttctaggaaactatgattctggttgttcaggattgttattattatagttgtgtaaaattattttattttgtgtgtattgtgcacagcttggggggggggcgggaaatgcactaattgtgctcttccttataaatggtacatattactgacacagacaaataaagtttctaattgtttctgatttaatcactagtgatacagcatattctgtatgaaatgttttctcctttctcattgtcatctacttcattttttgttttcatgttttgaagaaataaaaaccaaaatggta

SEQ ID NO: 29405 - DNA, 5111 bp, Homo sapiens
accgccttccctctgcccgcctccgcctcctccccctctctccggctcctccccctccctcgctccctcgccgcctccccctcccccgtgtccctcccctctcctcttctcctccctctatcccctctccctcccctcctccccggctctccctctcagtctcaggcttttctctctctcaatctctctctctctttcgggcggagtcgcccaccactgccagcccagcgctggggggacctgctccaggctgtagccgcaggaccccaccaccccccatggctcccctggccttggtgggggtcacactcctcctggcggctcccccatgctccggggcagccaccccaaccccctccctgccgcctcccccggccaatgacagcgacaccagcacagggggctgccaggggtcctaccgctgccagccgggggtgctgctgcccgtgtgggagcccgacgacccgtcgctgggtgacaaggcggcacgggcagtggtgtactttgtggccatggtctacatgtttctgggagtgtccatcatcgccgaccgtttcatggcggccatcgaggtcatcacgtcaaaagagaaggagatcaccatcaccaaggccaacggtgagaccagcgtgggcaccgttcgcatctggaatgagacggtgtccaacctcacgctcatggccctgggctcctccgcacctgagatcctgctgtcagtcatcgaagtctgcggccacaacttccaggcgggtgagctgggcccaggcaccatcgtgggcagcgctgccttcaacatgtttgtggtcatcgccgtgtgcatctacgtcatcccagccggcgagagccgcaagatcaagcacctgagagtcttctttgtcactgcctcttggagcatcttcgcctatgtctggctttatctcatccttgctgttttttcccccggtgtggtccaggtgtgggaggcgctgctgaccctggtcttcttcccggtgtgcgtggtattcgcctggatggccgacaagcggctgctcttctacaagtacgtgtacaagcgctaccgcaccgacccacgcagcggcatcatcataggcgccgagggcgaccccccgaagagcatcgagctggacggcacgttcgtgggcgccgaggccccaggtgagctgggcggcctgggcccgggccccgccgaggcgcgcgagctggacgccagccgccgcgaggtcatccagatcctcaaggacctcaagcagaagcacccggacaaggatctggagcagctggtgggcatcgccaactactacgcgctgctgcaccagcagaagagccgcgccttctaccgcatccaggccacgcggctgatgaccggcgccgggaacgtgctgcgcagacacgcggcggacgcctcgcgcagggcggcgccggccgagggcgcgggcgaggacgaagacgacggcgccagccgcatcttcttcgagcctagcctctaccactgcctggagaactgcggctccgtgctgctgtccgtcacgtgccagggcggcgagggcaacagcaccttctacgtggactaccgcactgaggacggctctgccaaggcgggctccgactacgagtacagcgagggcacgctggtgttcaaaccaggcgagacgcagaaggagctgcgcatcggcatcatcgacgacgacatcttcgaggaggacgagcatttcttcgtgcggctgctgaacctgcgcgtgggcgacgcgcagggcatgttcgagccggacggcggcgggcggcccaaggggcggctggtggcgccgctgctggccaccgtcaccatcctggacgacgaccacgcaggcatcttctccttccaggaccgcctgctgcacgtgagcgagtgcatgggcaccgtggacgtgcgcgtcgtgcgcagctcgggcgcgcgcggcaccgtgcgccttccctaccgcacggtggacggcacggcgcgcggcggcggcgtgcactacgaggacgcgtgcggagagctggagtttggcgacgacgagaccatgaaaactcttcaggtgaagatagttgatgacgaggaatatgagaaaaaggataatttcttcattgagctgggccagccccagtggcttaagcgagggatttcagctctgctactcaatcaaggggatggggacaggaagctaacagccgaggaggaggaggctcggaggatagcagagatgggcaagccagttcttggggagaactgccggctggaggtcatcatcgaggagtcatatgattttaagaacacggtggataaactcatcaagaaaacgaacttggccttggtaattgggacccattcatggagggagcagtttttagaggcaattacggtgagcgcaggggacgaggaggaggaggaggacgggtcccgggaggagcggctgccgtcgtgctttgactacgtgatgcacttcctgacggtgttctggaaggtgctcttcgcctgtgtgccccccaccgagtactgccacggctgggcctgctttggtgtctccatcctggtcatcggcctgctcaccgccctcattggggacctcgcctcccacttcggctgcaccgttggcctcaaggactctgtcaatgctgttgtcttcgttgccctgggcacctccatccctgacacgttcgccagcaaggtggcggcgctgcaggaccagtgcgccgacgcgtccatcggcaacgtgaccggctccaacgcggtgaacgtgttccttggcctgggcgtcgcctggtctgtggccgccgtgtactgggcggtgcagggccgccccttcgaggtgcgcactggcacgctggccttctccgtcacgctcttcaccgtcttcgccttcgtgggcattgccgtgctgctgtaccggcgccggccgcacatcggcggcgagctgggcggcccgcgcggacccaagctcgccaccaccgcgctcttcctgggcctctggctcctgtacatcctcttcgccagcctggaggcgtactgccacatccggggcttctagggcctcgcgcagagactcgtccccaccgcccgcccggggctagggactcggctgcacctgctcttggaccctggtctccttttccccccagactcggcctcctctcctgggactcggcctcccttctccgccccctcccctggctttgattgccctgttctgtgtccccagtagctcagccttccctcttcctctcgggagcctccccggttcctcccctgcggtgaccccaactccagcccatcctgttggtgaccgtctatatccctggggaaatttccaccccagtcccctccccagggaaccacccccagtaaccatcctggggagtttaaggtctctctccttggtcacccagcctggctttgcccccaaagtctcccttcccctagtgaccccccccccacttcaccccatgtcccagagcctcagaacccaccctccctgggggaccctcgaaggaggctgtcagaggccgtctcagctcccagcccttccccccagccctcagggagctccgctcagccccggcggggaggagcgggtgggtgtgcgcgcaaggaggccgcacaccgttccttccaatccctccactcgggttcttgggaggacactcattctccaggctcggagacgaggggagaagtttggggtttcagtcccagggcttagccggaggaagcacattttgaacctgcaacttcagacattccagctcccccactcgccctccactacctctgagagcccagccacgccttggagggaggggcttgtgtgtgtatatagtgtgtttgggggaggggggacgcgggagggtgcatgtcttgggaaaagggggtgacagacaacttttgagagggcagcagactccctcagccatgagaaccagctttggggaggaggccgggaatcaaagcgagtccagttgatctcccctgacaatctggaaggttccttttgccctcagtgccagccaatccgggcaggaccctcgaagaggagaccgagggtcccagaggaccaatgctacaagccagcaaatgctgccacatctctgcctgatggggggtggggatgggtggggggatgggactgggccaagggatctgggtgggcatttttaactttggaggccttccatctgtcggtaggccatctgcattttcttactgttgatgtttcctgcccaaaggacacatttgggcagtgccacccactccttgggcccctaggatgacccaactacccccataactttctgcttcccacaggttttcagcattctatcgtcctgttgtgctcagccccaacatcccagacccgttacccactacccttctctcccccagctcatcatcagtcgctgtctcttttctgtgatttctgtaaaagttgccataaaactttgaaattctgcctgaaaaacagtcccgtgggaagctgggattcaggaggagggggctaataaggtctctgactgagatttgggcaactgttaaaccaagtaatctgggtttttgcggcccgcggtcgtctgcgggacacacccacatatagcagcagcgccggggtccagccgccaagctcttccactcgccacgcccccatcagtaatgagcttccactagccacgcccccatccgtcagcctagctcttccactagccacacccccatccatcagtcatgggcttccacaagccacgcacctccactctccatgcccccattcgtcagtcgtgggtttccactaaccacgcccccattcatcagccaagctcctccacttgctacgcccgcatccgtcaattacgggtttccactaaccacgcccccattcatcagcctagctcttccactaatcacacccccacttatcagtcgtgcttcagccacgccttcctgcttcagtcaggggcttccactagccacgcccccatgcatgagccacaaactgtttctctttatgggcatcctgggaacacaaaagagagacgttcatttgcctgagccaaagagctggggttgatggggtttcctaaataaagcaagtaattttctcaga

SEQ ID NO: 29406 - DNA, 5190 bp, Homo sapiens
accgccttccctctgcccgcctccgcctcctccccctctctccggctcctccccctccctcgctccctcgccgcctccccctcccccgtgtccctcccctctcctcttctcctccctctatcccctctccctcccctcctccccggctctccctctcagtctcaggcttttctctctctcaatctctctctctctttcgggcggagtcgcccaccactgccagcccagcgctggggggacctgctccaggctgtagccgcaggaccccaccaccccccatggctcccctggccttggtgggggtcacactcctcctggcggctcccccatgctccggggcagccaccccaaccccctccctgccgcctcccccggccaatgacagcgacaccagcacagggggctgccaggggtcctaccgctgccagccgggggtgctgctgcccgtgtgggagcccgacgacccgtcgctgggtgacaaggcggcacgggcagtggtgtactttgtggccatggtctacatgtttctgggagtgtccatcatcgccgaccgtttcatggcggccatcgaggtcatcacgtcaaaagagaaggagatcaccatcaccaaggccaacggtgagaccagcgtgggcaccgttcgcatctggaatgagacggtgtccaacctcacgctcatggccctgggctcctccgcacctgagatcctgctgtcagtcatcgaagtctgcggccacaacttccaggcgggtgagctgggcccaggcaccatcgtgggcagcgctgccttcaacatgtttgtggtcatcgccgtgtgcatctacgtcatcccagccggcgagagccgcaagatcaagcacctgagagtcttctttgtcactgcctcttggagcatcttcgcctatgtctggctttatctcatccttgctgttttttcccccggtgtggtccaggtgtgggaggcgctgctgaccctggtcttcttcccggtgtgcgtggtattcgcctggatggccgacaagcggctgctcttctacaagtacgtgtacaagcgctaccgcaccgacccacgcagcggcatcatcataggcgccgagggcgaccccccgaagagcatcgagctggacggcacgttcgtgggcgccgaggccccaggtgagctgggcggcctgggcccgggccccgccgaggcgcgcgagctggacgccagccgccgcgaggtcatccagatcctcaaggacctcaagcagaagcacccggacaaggatctggagcagctggtgggcatcgccaactactacgcgctgctgcaccagcagaagagccgcgccttctaccgcatccaggccacgcggctgatgaccggcgccgggaacgtgctgcgcagacacgcggcggacgcctcgcgcagggcggcgccggccgagggcgcgggcgaggacgaagacgacggcgccagccgcatcttcttcgagcctagcctctaccactgcctggagaactgcggctccgtgctgctgtccgtcacgtgccagggcggcgagggcaacagcaccttctacgtggactaccgcactgaggacggctctgccaaggcgggctccgactacgagtacagcgagggcacgctggtgttcaaaccaggcgagacgcagaaggagctgcgcatcggcatcatcgacgacgacatcttcgaggaggacgagcatttcttcgtgcggctgctgaacctgcgcgtgggcgacgcgcagggcatgttcgagccggacggcggcgggcggcccaaggggcggctggtggcgccgctgctggccaccgtcaccatcctggacgacgaccacgcaggcatcttctccttccaggaccgcctgctgcacgtgagcgagtgcatgggcaccgtggacgtgcgcgtcgtgcgcagctcgggcgcgcgcggcaccgtgcgccttccctaccgcacggtggacggcacggcgcgcggcggcggcgtgcactacgaggacgcgtgcggagagctggagtttggcgacgacgagaccatgaaaactcttcaggtgaagatagttgatgacgaggaatatgagaaaaaggataatttcttcattgagctgggccagccccagtggcttaagcgagggatttcagctctgctactcaatcaaggggatggggacaggaagctaacagccgaggaggaggaggctcggaggatagcagagatgggcaagccagttcttggggagaactgccggctggaggtcatcatcgaggagtcatatgattttaagaacacggtggataaactcatcaagaaaacgaacttggccttggtaattgggacccattcatggagggagcagtttttagaggcaattacggtgagcgcaggggacgaggaggaggaggaggacgggtcccgggaggagcggctgccgtcgtgctttgactacgtgatgcacttcctgacggtgttctggaaggtgctcttcgcctgtgtgccccccaccgagtactgccacggctgggcctgctttggtgtctccatcctggtcatcggcctgctcaccgccctcattggggacctcgcctcccacttcggctgcaccgttggcctcaaggactctgtcaatgctgttgtcttcgttgccctgggcacctccatccctggtaacaccctgggagactttggtggggtaggatctcagatgagccaggcaggggcaacacaggatcctgccaaaatgagacacgttcgccagcaaggtggcggcgctgcaggaccagtgcgccgacgcgtccatcggcaacgtgaccggctccaacgcggtgaacgtgttccttggcctgggcgtcgcctggtctgtggccgccgtgtactgggcggtgcagggccgccccttcgaggtgcgcactggcacgctggccttctccgtcacgctcttcaccgtcttcgccttcgtgggcattgccgtgctgctgtaccggcgccggccgcacatcggcggcgagctgggcggcccgcgcggacccaagctcgccaccaccgcgctcttcctgggcctctggctcctgtacatcctcttcgccagcctggaggcgtactgccacatccggggcttctagggcctcgcgcagagactcgtccccaccgcccgcccggggctagggactcggctgcacctgctcttggaccctggtctccttttccccccagactcggcctcctctcctgggactcggcctcccttctccgccccctcccctggctttgattgccctgttctgtgtccccagtagctcagccttccctcttcctctcgggagcctccccggttcctcccctgcggtgaccccaactccagcccatcctgttggtgaccgtctatatccctggggaaatttccaccccagtcccctccccagggaaccacccccagtaaccatcctggggagtttaaggtctctctccttggtcacccagcctggctttgcccccaaagtctcccttcccctagtgaccccccccccacttcaccccatgtcccagagcctcagaacccaccctccctgggggaccctcgaaggaggctgtcagaggccgtctcagctcccagcccttccccccagccctcagggagctccgctcagccccggcggggaggagcgggtgggtgtgcgcgcaaggaggccgcacaccgttccttccaatccctccactcgggttcttgggaggacactcattctccaggctcggagacgaggggagaagtttggggtttcagtcccagggcttagccggaggaagcacattttgaacctgcaacttcagacattccagctcccccactcgccctccactacctctgagagcccagccacgccttggagggaggggcttgtgtgtgtatatagtgtgtttgggggaggggggacgcgggagggtgcatgtcttgggaaaagggggtgacagacaacttttgagagggcagcagactccctcagccatgagaaccagctttggggaggaggccgggaatcaaagcgagtccagttgatctcccctgacaatctggaaggttccttttgccctcagtgccagccaatccgggcaggaccctcgaagaggagaccgagggtcccagaggaccaatgctacaagccagcaaatgctgccacatctctgcctgatggggggtggggatgggtggggggatgggactgggccaagggatctgggtgggcatttttaactttggaggccttccatctgtcggtaggccatctgcattttcttactgttgatgtttcctgcccaaaggacacatttgggcagtgccacccactccttgggcccctaggatgacccaactacccccataactttctgcttcccacaggttttcagcattctatcgtcctgttgtgctcagccccaacatcccagacccgttacccactacccttctctcccccagctcatcatcagtcgctgtctcttttctgtgatttctgtaaaagttgccataaaactttgaaattctgcctgaaaaacagtcccgtgggaagctgggattcaggaggagggggctaataaggtctctgactgagatttgggcaactgttaaaccaagtaatctgggtttttgcggcccgcggtcgtctgcgggacacacccacatatagcagcagcgccggggtccagccgccaagctcttccactcgccacgcccccatcagtaatgagcttccactagccacgcccccatccgtcagcctagctcttccactagccacacccccatccatcagtcatgggcttccacaagccacgcacctccactctccatgcccccattcgtcagtcgtgggtttccactaaccacgcccccattcatcagccaagctcctccacttgctacgcccgcatccgtcaattacgggtttccactaaccacgcccccattcatcagcctagctcttccactaatcacacccccacttatcagtcgtgcttcagccacgccttcctgcttcagtcaggggcttccactagccacgcccccatgcatgagccacaaactgtttctctttatgggcatcctgggaacacaaaagagagacgttcatttgcctgagccaaagagctggggttgatggggtttcctaaataaagcaagtaattttctcaga

SEQ ID NO: 29407 - DNA, 1606 bp, Homo sapiens
ctctctctttcgggcggagtcgcccaccactgccagcccagcgctggggggacctgctccaggctgtagccgcaggaccgcctgctgcacgtgagcgagtgcatgggcaccgtggacgtgcgcgtcgtgcgcagctcgggcgcgcgcggcaccgtgcgccttccctaccgcacggtggacggcacggcgcgcggcggcggcgtgcactacgaggacgcgtgcggagagctggagtttggcgacgacgagaccatgaaaactcttcaggtgaagatagttgatgacgaggaatatgagaaaaaggataatttcttcattgagctgggccagccccagtggcttaagcgagggatttcagctctgctactcaatcaaggggatggggacaggaagctaacagccgaggaggaggaggctcggaggatagcagagatgggcaagccagttcttggggagaactgccggctggaggtcatcatcgaggagtcatatgattttaagaacacggtggataaactcatcaagaaaacgaacttggccttggtaattgggacccattcatggagggagcagtttttagaggcaattacggtgagcgcaggggacgaggaggaggaggaggacgggtcccgggaggagcggctgccgtcgtgctttgactacgtgatgcacttcctgacggtgttctggaaggtgctcttcgcctgtgtgccccccaccgagtactgccacggctgggcctgctttggtgtctccatcctggtcatcggcctgctcaccgccctcattggggacctcgcctcccacttcggctgcaccgttggcctcaaggactctgtcaatgctgttgtcttcgttgccctgggcacctccatccctgacacgttcgccagcaaggtggcggcgctgcaggaccagtgcgccgacgcgtccatcggcaacgtgaccggctccaacgcggtgaacgtgttccttggcctgggcgtcgcctggtctgtggccgccgtgtactgggcggtgcagggccgccccttcgaggtgcgcactggcacgctggccttctccgtcacgctcttcaccgtcttcgccttcgtgggcattgccgtgctgctgtaccggcgccggccgcacatcggcggcgagctgggcggcccgcgcggacccaagctcgccaccaccgcgctcttcctgggcctctggctcctgtacatcctcttcgccagcctggaggcgtactgccacatccggggcttctagggcctcgcgcagagactcgtccccaccgcccgcccggggctagggactcggctgcacctgctcttggaccctggtctccttttccccccagactcggcctcctctcctgggactcggcctcccttctccgccccctcccctggctttgattgccctgttctgtgtccccagtagctcagccttccctcttcctctcgggagcctccccggttcctcccctgcggtgaccccaactccagcccatcctgttggtgaccgtctatatccctggggaaatttccaccccagtcccctccccagggaaccacccccagtaaccatcctggggagtttaaggtctctctccttg

SEQ ID NO: 29408 - DNA, 2445 bp, Homo sapiens
tcaatctctctctctctttcgggcggagtcgcccaccactgccagcccagcgctggggggacctgctccaggctgtagccgcaggtgtgggaggcgctgctgaccctggtcttcttcccggtgtgcgtggtattcgcctggatggccgacaagcggctgctcttctacaagtacgtgtacaagcgctaccgcaccgacccacgcagcggcatcatcataggcgccgagggcgaccccccgaagagcatcgagctggacggcacgttcgtgggcgccgaggccccaggtgagctgggcggcctgggcccgggccccgccgaggcgcgcgagctggacgccagccgccgcgaggtcatccagatcctcaaggacctcaagcagaagcacccggacaaggatctggagcagctggtgggcatcgccaactactacgcgctgctgcaccagcagaagagccgcgccttctaccgcatccaggccacgcggctgatgaccggcgccgggaacgtgctgcgcagacacgcggcggacgcctcgcgcagggcggcgccggccgagggcgcgggcgaggacgaagacgacggcgccagccgcatcttcttcgagcctagcctctaccactgcctggagaactgcggctccgtgctgctgtccgtcacgtgccagggcggcgagggcaacagcaccttctacgtggactaccgcactgaggacggctctgccaaggcgggctccgactacgagtacagcgagggcacgctggtgttcaaaccaggcgagacgcagaaggagctgcgcatcggcatcatcgacgacgacatcttcgaggaggacgagcatttcttcgtgcggctgctgaacctgcgcgtgggcgacgcgcagggcatgttcgagccggacggcggcgggcggcccaaggggcggctggtggcgccgctgctggccaccgtcaccatcctggacgacgaccacgcaggcatcttctccttccaggaccgcctgctgcacgtgagcgagtgcatgggcaccgtggacgtgcgcgtcgtgcgcagctcgggcgcgcgcggcaccgtgcgccttccctaccgcacggtggacggcacggcgcgcggcggcggcgtgcactacgaggacgcgtgcggagagctggagtttggcgacgacgagaccatgaaaactcttcaggtgaagatagttgatgacgaggaatatgagaaaaaggataatttcttcattgagctgggccagccccagtggcttaagcgagggatttcagctctgctactcaatcaaggggatggggacaggaagctaacagccgaggaggaggaggctcggaggatagcagagatgggcaagccagttcttggggagaactgccggctggaggtcatcatcgaggagtcatatgattttaagaacacggtggataaactcatcaagaaaacgaacttggccttggtaattgggacccattcatggagggagcagtttttagaggcaattacggtgagcgcaggggacgaggaggaggaggaggacgggtcccgggaggagcggctgccgtcgtgctttgactacgtgatgcacttcctgacggtgttctggaaggtgctcttcgcctgtgtgccccccaccgagtactgccacggctgggcctgctttggtgtctccatcctggtcatcggcctgctcaccgccctcattggggacctcgcctcccacttcggctgcaccgttggcctcaaggactctgtcaatgctgttgtcttcgttgccctgggcacctccatccctgacacgttcgccagcaaggtggcggcgctgcaggaccagtgcgccgacgcgtccatcggcaacgtgaccggctccaacgcggtgaacgtgttccttggcctgggcgtcgcctggtctgtggccgccgtgtactgggcggtgcagggccgccccttcgaggtgcgcactggcacgctggccttctccgtcacgctcttcaccgtcttcgccttcgtgggcattgccgtgctgctgtaccggcgccggccgcacatcggcggcgagctgggcggcccgcgcggacccaagctcgccaccaccgcgctcttcctgggcctctggctcctgtacatcctcttcgccagcctggaggcgtactgccacatccggggcttctagggcctcgcgcagagactcgtccccaccgcccgcccggggctagggactcggctgcacctgctcttggaccctggtctccttttccccccagactcggcctcctctcctgggactcggcctcccttctccgccccctcccctggctttgattgccctgttctgtgtccccagtagctcagccttccctcttcctctcgggagcctccccggttcctcccctgcggtgaccccaactccagcccatcctgttggtgaccgtctatatccctg

SEQ ID NO: 29409 - DNA, 4516 bp, Homo sapiens
cggcgcgcctggacccctgcccctctctgggtggagaagctcccggccgcttcccggtttcactccttctcagcctgggctcccagccccctctctccttttcctggactggctctcacccccttcggtccccttcctttagctcaggctccctaccccttcctttagcccacagcccagagtcccagctcctcagtcactttcctcagccaaaggtcccagccttccttcttcctttcctttgcactatccctatcctgccccttcctctatccctagggctcagtttcccacatccgtcctcccccttcccaggcccggagttccagaccttttggtctcctttcgtggtcgttcctgggtccttgccccctttccccactttggagttccagattgcaaacccagcctccctccacccccagaaaattgcttccatggaaatgcctctctaaaacatgaacttttcctagagactacgccagtctctcttcccacttgctgaccctttgctacctatgtgcccggttttactctcatttgggtaaggtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctgttaatcattccgtcactgatcatggcatgaagccgcgcaaggcctttccagtcctgggcatcgactacacacacgtgcgcacccccttcgagatctccctctggatccttctggcctgcctcatgaagataggtttccatgtgatccccactatctcaagcatcgtcccggagagctgcctgctgatcgtggtggggctgctggtggggggcctgatcaagggtgtaggcgagacaccccccttcctgcagtccgacgtcttcttcctcttcctgctgccgcccatcatcctggatgcgggctacttcctgccactgcggcagttcacagaaaacctgggcaccatcctgatctttgccgtggtgggcacgctgtggaacgccttcttcctgggcggcctcatgtacgccgtgtgcctggtgggcggtgagcagatcaacaacatcggcctcctggacaacctgctcttcggcagcatcatctcggccgtggaccccgtggcggttctggctgtctttgaggaaattcacatcaatgagctgctgcacatccttgtttttggggagtccttgctcaatgacgccgtcactgtggtcctgtatcacctctttgaggagtttgccaactacgaacacgtgggcatcgtggacatcttcctcggcttcctgagcttcttcgtggtggccctgggcggggtgcttgtgggcgtggtctacggggtcatcgcagccttcacctcccgatttacctcccacatccgggtcatcgagccgctcttcgtcttcctctacagctacatggcctacttgtcagccgagctcttccacctgtcaggcatcatggcgctcatagcctcaggagtggtgatgcgcccctatgtggaggccaacatctcccacaagtcccacaccaccatcaaatacttcctgaagatgtggagcagcgtcagcgagaccctcatcttcatcttcctcggcgtctccacggtggccggctcccaccactggaactggaccttcgtcatcagcaccctgctcttctgcctcatcgcccgcgtgctgggggtgctgggcctgacctggttcatcaacaagttccgtatcgtgaagctgacccccaaggaccagttcatcatcgcctatgggggcctgcgaggggccatcgccttctctctgggctacctcctggacaagaagcacttccccatgtgtgacctgttcctcactgccatcatcactgtcatcttcttcaccgtctttgtgcagggcatgaccattcggcccctggtagacctgttggctgtgaagaaaaagcaagagacgaagcgctccatcaacgaagagatccacacacagttcctggaccaccttctgacaggcatcgaagacatctgtggccactacggtcaccaccactggaaggacaagctcaaccggtttaataagaaatatgtgaagaagtgtctgatagctggcgagcgctccaaggagccccagctcattgccttctaccacaagatggagatgaagcaggccatcgagctggtggagagcgggggcatgggcaagatcccctctgccgtctccaccgtctccatgcagaacatccaccccaagtccctgccttccgagcgcatcctgccagcactgtccaaggacaaggaggaggagatccgcaaaatcctgaggaacaacttgcagaagaccaggcagcggctgcggtcctacaacagacacacgctggtggcagacccctacgaggaagcctggaaccagatgctgctccggaggcagaaggcccggcagctggagcagaagatcaacaactacctgacggtgccagcccacaagctggactcacccaccatgtctcgggcccgcatcggctcagacccactggcctatgagccgaaggaggacctgcctgtcatcaccatcgacccggcttccccgcagtcacccgagtctgtggacctggtgaatgaagagctgaagggcaaagtcttagggttgagccgggatcctgcaaaggtggctgaggaggacgaggacgacgatgggggcatcatgatgcggagcaaggagacttcgtccccaggaaccgacgatgtcttcacccccgcgcccagtgacagccccagctcccagaggatacagcgctgcctcagtgacccaggcccacaccctgagcctggggagggagaaccgttcttccccaaggggcagtaacaccagggccagcaggcagcgcctgtcccctcacagactcttccaccagagcaggggctgctgggggctccccttgcccttcctgacccggattggccctgcccctccccctaccgcatggcagctgggcccacagcccccaccccagcacagctcctcccctgccgcctcccgggaagcatcctccccaccagagctgcctccccaatccatttggcagaactgctggggctggtgaggccggccctgcccctccctagatccaggcttctcccggacctggactagggcctcggaggctcctccctctgcctcatcctcctcctcattcagaccaatcttagtttctaaccaaagagtctctggctcagctgtggtcccacccaggaagggagggagctgaggcctcccttgagtaggccctgctttatcaggggacaaaccaggggtaccaggcacatggctgggggagggactgctgacccaccaaggtctcacactcctcctgccagctctgtcaccctggccaccacccaacctgtccttactcagagctgcgggctgagggcatctctgagtgtctctgcctggagcaggggtggtttctacggtgacagtgacgtgactcagagcttttcgaactgtgctcccacggggaccactgggcccctcaggggaagctgctaggggaaggactggccgtggctccagaatgtgctgcctttttaagttttgtttgttcacactcctatatatgattgtttgcacagagggcgctcctgtttttaaaacattttgaaaacccctggctgaacagtgctctgcctctaactccctcctcacactccagaattacccttcctcatctgtgcctgtctgtccaacccctcccccacgtctctctgcctgctgggctcttaactgttgctcgaagactgtgacatcagaagtaactcccactcctaatcaagagtctctccagcctcacagatgctggcctcttggcacctgcctagctcttgggcctgacctccagtcctgctggcctgctcttacttcccccaccctgggtttggcccctggaacctttcccttgtgtgtaccacaccctgcctgctgtggagcccattgtggaggcggtgggggggagaaggcctcccctgaggatcccctgtcccctggggctggtggattgggcagaatcctgggcccccagagacctttgcccacacacactccttccccttgtccctggggcactcccccaggattgtgcaatagtcagagtgtccctttttgcaggggactgggccatgggtcctcggcccatctgtccatcctcctctccatgcaagtgctgtttgggcaggagtcaccatgcaagggtgacatcgacaaccacgtaccaagccaccgcagctgctgccactctgctgcctgtacagaagaaactgaatctttttcatattctaataaatcaatgtgagttttt

SEQ ID NO: 29410 - DNA, 696 bp, Homo sapiens
atctgacttaggcttttaaagggatccttctggctgctttgttgaaacaataatctgggtggggaaaatggcactgcttggaccagagtgggcaatggaggtggtcagaaatggatggattctggaaatattttgaagattgaattgacactatttgtggaggattgatatgacagaaaggagccaaggatgactcaagtttttggccagagattattcgaaagcccttatgagactgcagatgtggacgtgaaatcgttttgtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctgttaatcattccgtcactgatcatggcatgaagccgcgcaaggcctttccagtcctgggcatcgactacacacacgtgcgcacccccttcgagatctccctctggatccttctggcctgcctcatgaagatagggtttccatgtgatccccactatctcaagcatcgtcccggagagctgcctgctga

SEQ ID NO: 29411 - DNA, 2183 bp, Homo sapiens
caggcccggagttccagaccttttggtctcctttcgtggtcgttcctgggtccttgccccctttccccactttggagttccagattgcaaacccagcctccctccacccccagaaaattgcttccatggaaatgcctctctaaaacatgaacttttcctagagactacgccagtctctcttcccacttgctgaccctttgctacctatgtgcccggttttactctcatttgggtaaggtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctgttaatcattccgtcactgatcatggcatgaagccgcgcaaggcctttccagtcctgggcatcgactacacacacgtgcgcacccccttcgagatctccctctggatccttctggcctgcctcatgaagataggtttccatgtgatccccactatctcaagcatcgtcccggagagctgcctgctgatcgtggtggggctgctggtggggggcctgatcaagggtgtaggcgagacaccccccttcctgcagtccgacgtcttcttcctcttcctgctgccgcccatcatcctggatgcgggctacttcctgccactgcggcagttcacagaaaacctgggcaccatcctgatctttgccgtggtgggcacgctgtggaacgccttcttcctgggcggcctcatgtacgccgtgtgcctggtgggcggtgagcagatcaacaacatcggcctcctggacaacctgctcttcggcagcatcatctcggccgtggaccccgtggcggttctggctgtctttgaggaaattcacatcaatgagctgctgcacatccttgtttttggggagtccttgctcaatgacgccgtcactgtggtcctgtatcacctctttgaggagtttgccaactacgaacacgtgggcatcgtggacatcttcctcggcttcctgagcttcttcgtggtggccctgggcggggtgcttgtgggcgtggtctacggggtcatcgcagccttcacctcccgatttacctcccacatccgggtcatcgagccgctcttcgtcttcctctacagctacatggcctacttgtcagccgagctcttccacctgtcaggcatcatggcgctcatagcctcaggagtggtgatgcgcccctatgtggaggccaacatctcccacaagtcccacaccaccatcaaatacttcctgaagatgtggagcagcgtcagcgagaccctcatcttcatcttcctcggcgtctccacggtggccggctcccaccactggaactggaccttcgtcatcagcaccctgctcttctgcctcatcgcccgcgtgctgggggtgctgggcctgacctggttcatcaacaagttccgtatcgtgaagctgacccccaaggaccagttcatcatcgcctatgggggcctgcgaggggccatcgccttctctctgggctacctcctggacaagaagcacttccccatgtgtgacctgttcctcactgccatcatcactgtcatcttcttcaccgtctttgtgcaggtgctgggccagggcagggcaggcccttgccttggggaccctcacaggctgttcccgtggaaagagaggaaagcgtgtgatttgaaatgcgattctagtcccagctccaccactaacttgctgtgtgaccttgggcgagccactccccctttctgggcctcagtttcttcaatcgtaaagtgagaattgtgatgagtcattgcagagtgactgatcagaatgtaaaggaaccagaatgctgcccaacttaatttggaactcatagagcattaagagaagtgggtactggccgggcacggtgactcaacgcctgtaatcccagcactttgggaggctgagggggtggatcacctgaggtcaggagtttgagaccagcctgactaacatggtgaaaccccgtctctactaaaaatacaaaattagtgggcatggtg

SEQ ID NO: 29412 - DNA, 3165 bp, Homo sapiens
ttttttaccttgattttgcagttgtatgtgctaatgattttccaagcccattttcattgaaggcaacattggggagggggcctccctccagagccagcctgcctgggtttaaatcatggctttactgcttctctgggatcttagaaagctgcttatcctctctgagcctcagtttctgcatctgttaaatagagacaatggaaggacctccctcttagtgttgcggatattggagagctgattgatgctagaacacttccaagcacgtgtgttggtcacatggcaggtgtgcagttccatctgctgctgctgttattactcggtcctcctcacagtcctggtggggaggcagtgcagaggtagttttccctgtgtgtggggcctgacttccatggggttgcagagcaagtctgtggtgcagtccacatctgaacccaggctgtctgctgcctggcccaggccagatgaccagtgtgggggtcatttggcagtgaaacctctgaccgtgtctccaggaagaagcaggccttaaggacctgtctttagataagtgctgggaggtgggagagttctcacacccttgggtcctgggagagagcagagcagagagggcatcctagccttgggggcctggggtgagggagggaggctctgtggcctccctgcctgggtagcagaactggagtgcctgacacctgcctgccccccagggcatgaccattcggcccctggtagacctgttggctgtgaagaaaaagcaagagacgaagcgctccatcaacgaagagatccacacacagttcctggaccaccttctgacaggcatcgaagacatctgtggccactacggtcaccaccactggaaggacaagctcaaccggtttaataagaaatatgtgaagaagtgtctgatagctggcgagcgctccaaggagccccagctcattgccttctaccacaagatggagatgaagcaggccatcgagctggtggagagcgggggcatgggcaagatcccctctgccgtctccaccgtctccatgcagaacatccaccccaagtccctgccttccgagcgcatcctgccagcactgtccaaggacaaggaggaggagatccgcaaaatcctgaggaacaacttgcagaagaccaggcagcggctgcggtcctacaacagacacacgctggtggcagacccctacgaggaagcctggaaccagatgctgctccggaggcagaaggcccggcagctggagcagaagatcaacaactacctgacggtgccagcccacaagctggactcacccaccatgtctcgggcccgcatcggctcagacccactggcctatgagccgaaggaggacctgcctgtcatcaccatcgacccggcttccccgcagtcacccgagtctgtggacctggtgaatgaagagctgaagggcaaagtcttagggttgagccgggatcctgcaaaggtggctgaggaggacgaggacgacgatgggggcatcatgatgcggagcaaggagacttcgtccccaggaaccgacgatgtcttcacccccgcgcccagtgacagccccagctcccagaggatacagcgctgcctcagtgacccaggcccacaccctgagcctggggagggagaaccgttcttccccaaggggcagtaacaccagggccagcaggcagcgcctgtcccctcacagactcttccaccagagcaggggctgctgggggctccccttgcccttcctgacccggattggccctgcccctccccctaccgcatggcagctgggcccacagcccccaccccagcacagctcctcccctgccgcctcccgggaagcatcctccccaccagagctgcctccccaatccatttggcagaactgctggggctggtgaggccggccctgcccctccctagatccaggcttctcccggacctggactagggcctcggaggctcctccctctgcctcatcctcctcctcattcagaccaatcttagtttctaaccaaagagtctctggctcagctgtggtcccacccaggaagggagggagctgaggcctcccttgagtaggccctgctttatcaggggacaaaccaggggtaccaggcacatggctgggggagggactgctgacccaccaaggtctcacactcctcctgccagctctgtcaccctggccaccacccaacctgtccttactcagagctgcgggctgagggcatctctgagtgtctctgcctggagcaggggtggtttctacggtgacagtgacgtgactcagagcttttcgaactgtgctcccacggggaccactgggcccctcaggggaagctgctaggggaaggactggccgtggctccagaatgtgctgcctttttaagttttgtttgttcacactcctatatatgattgtttgcacagagggcgctcctgtttttaaaacattttgaaaacccctggctgaacagtgctctgcctctaactccctcctcacactccagaattacccttcctcatctgtgcctgtctgtccaacccctcccccacgtctctctgcctgctgggctcttaactgttgctcgaagactgtgacatcagaagtaactcccactcctaatcaagagtctctccagcctcacagatgctggcctcttggcacctgcctagctcttgggcctgacctccagtcctgctggcctgctcttacttcccccaccctgggtttggcccctggaacctttcccttgtgtgtaccacaccctgcctgctgtggagcccattgtggaggcggtgggggggagaaggcctcccctgaggatcccctgtcccctggggctggtggattgggcagaatcctgggcccccagagacctttgcccacacacactccttccccttgtccctggggcactcccccaggattgtgcaatagtcagagtgtccctttttgcaggggactgggccatgggtcctcggcccatctgtccatcctcctctccatgcaagtgctgtttgggcaggagtcaccatgcaagggtgacatcgacaaccacgtaccaagccaccgcagctgctgccactctgctgcctgtacagaagaaactgaatctttttcatattctaataaatcaatgtgagttttt

SEQ ID NO: 29413 - DNA, 887 bp, Homo sapiens
gtagggaaggcgccccacagcgaggcttgacttggccctgggcccctttcagttcctggaccaccttctgacaggcatcgaagacatctgtggccactacggtcaccaccactggaaggacaagctcaaccggtttaataagaaatatgtgaagaagtgtctgatagctggcgagcgctccaaggagccccagctcattgccttctaccacaagatggagatgaagcaggccatcgagctggtggagagcgggggcatgggcaagatcccctctgccgtctccaccgtctccatgcagaacatccaccccaagtccctgccttccgagcgcatcctgccagcactgtccaaggacaaggaggaggagatccgcaaaatcctgaggaacaacttgcagaagaccaggcagcggctgcggtcctacaacagacacacgctggtggcagacccctacgaggaagcctggaaccagatgctgctccggaggcagaaggcccggcagctggagcagaagatcaacaactacctgacggtgccagcccacaagctggactcacccaccatgtctcgggcccgcatcggctcagacccactggcctatgagccgaaggaggacctgcctgtcatcaccatcgacccggcttccccgcagtcacccgagtctgtggacctggtgaatgaagagctgaagggcaaagtcttagggttgagccgggatcctgcaaaggtggctgaggaggacgaggacgacgatgggggcatcatgatgcggagcaaggagacttcgtccccaggaaccgacgatgtcttcacccccgcgcccagtgacagccccagctcccagaggatacagcgctgcctcagtgacccaggcccacaccctgagc

SEQ ID NO: 29414 - DNA, 2355 bp, Homo sapiens
attgcttccatggaaatgcctctctaaaacatgaacttttcctagagactacgccagtctctcttcccacttgctgaccctttgctacctatgtgcccggttttactctcatttgggtaaggtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctgttaatcattccgtcactgatcatggcatgaagccgcgcaaggcctttccagtcctgggcatcgactacacacacgtgcgcacccccttcgagatctccctctggatccttctggcctgcctcatgaagataggtcctgtatcacctctttgaggagtttgccaactacgaacacgtgggcatcgtggacatcttcctcggcttcctgagcttcttcgtggtggccctgggcggggtgcttgtgggcgtggtctacggggtcatcgcagccttcacctcccgatttacctcccacatccgggtcatcgagccgctcttcgtcttcctctacagctacatggcctacttgtcagccgagctcttccacctgtcaggcatcatggcgctcatagcctcaggagtggtgatgcgcccctatgtggaggccaacatctcccacaagtcccacaccaccatcaaatacttcctgaagatgtggagcagcgtcagcgagaccctcatcttcatcttcctcggcgtctccacggtggccggctcccaccactggaactggaccttcgtcatcagcaccctgctcttctgcctcatcgcccgcgtgctgggggtgctgggcctgacctggttcatcaacaagttccgtatcgtgaagctgacccccaaggaccagttcatcatcgcctatgggggcctgcgaggggccatcgccttctctctgggctacctcctggacaagaagcacttccccatgtgtgacctgttcctcactgccatcatcactgtcatcttcttcaccgtctttgtgcagggcatgaccattcggcccctggtagacctgttggctgtgaagaaaaagcaagagacgaagcgctccatcaacgaagagatccacacacagttcctggaccaccttctgacaggcatcgaagacatctgtggccactacggtcaccaccactggaaggacaagctcaaccggtttaataagaaatatgtgaagaagtgtctgatagctggcgagcgctccaaggagccccagctcattgccttctaccacaagatggagatgaagcaggccatcgagctggtggagagcgggggcatgggcaagatcccctctgccgtctccaccgtctccatgcagaacatccaccccaagtccctgccttccgagcgcatcctgccagcactgtccaaggacaaggaggaggagatccgcaaaatcctgaggaacaacttgcagaagaccaggcagcggctgcggtcctacaacagacacacgctggtggcagacccctacgaggaagcctggaaccagatgctgctccggaggcagaaggcccggcagctggagcagaagatcaacaactacctgacggtgccagcccacaagctggactcacccaccatgtctcgggcccgcatcggctcagacccactggcctatgagccgaaggaggacctgcctgtcatcaccatcgacccggcttccccgcagtcacccgagtctgtggacctggtgaatgaagagctgaagggcaaagtcttagggttgagccgggatcctgcaaaggtggctgaggaggacgaggacgacgatgggggcatcatgatgcggagcaaggagacttcgtccccaggaaccgacgatgtcttcacccccgcgcccagtgacagccccagctcccagaggatacagcgctgcctcagtgacccaggcccacaccctgagcctggggagggagaaccgttcttccccaaggggcagtaacaccagggccagcaggcagcgcctgtcccctcacagactcttccaccagagcaggggctgctgggggctccccttgcccttcctgacccggattggccctgcccctccccctaccgcatggcagctgggcccacagcccccaccccagcacagctcctcccctgccgcctcccgggaagcatcctccccaccagagctgcctccccaatccatttggcag

SEQ ID NO: 29415 - DNA, 5410 bp, Homo sapiens
ccggtgccgcagcagcggcgggtggctgtcgctgccctgccctgcacggggcagggcggagcgggctgagcagcccgggcgcgatgcgttgagcgctcggagggccaaccgccggtccccttggcggcaaccggcggcacccatggaaccactgggcaactggaggagcctgcgggcgccactgcctccgatgctgttgctgctgctcctgcaggtggcggggcccgtgggcgccctggcggagaccttgctgaacgcgccgagggccatgggcaccagttccagcccgcctagccctgcgagcgtggtggctcccggaacgacgctgttcgaggagagccggctgcctgtgtttacgctggattacccccacgtgcagatccccttcgagatcaccctttggatcctgctggcctccctggccaagattggcttccatctgtatcacaagttgcccacaatagtgcctgagagctgccttcttataatggttggacttctactaggtgggattatttttggtgttgatgagaagtctccccctgcaatgaagactgatgtatttttcttgtacctcctcccacccatcgtgctggatgccggctatttcatgcccactcgcccattctttgagaacattggcacgattttctggtatgctgtggtagggacactttggaattccattggcattggggtgtctttgtttggtatctgccagatcgaagcattcggcctcagcgacatcactttgctccagaacctgctctttggcagcttaatctcagctgtcgatcctgtggctgtgcttgctgtctttgagaacattcacgtcaatgagcagctctacatcctggtctttggagagtccctgctgaatgatgcagtaacagtggtcctgtacaacttgttcaagtcgttttgccagatgaaaaccattgagaccattgatgtgtttgcaggaatcgccaacttctttgttgtgggaatcggtggggtgctgattggcatcttcttgggctttatagcggcatttactactcgattcacccataatatccgagtgatcgagccactgtttgttttcctgtacagttatttgtcctacatcacagctgaaatgtttcacctctcaggcatcatggcaatcactgcttgtgcaatgactatgaataagtacgtagaagaaaatgtatctcagaaatcctacacgaccatcaagtacttcatgaagatgctgagcagtgtcagcgaaaccttgatcttcatcttcatgggtgtgtctaccgtgggcaagaaccacgagtggaactgggccttcgtctgcttcaccctggccttctgcctcatgtggcgagccctgggtgtttttgtcctgactcaggtcattaataggttccggaccattcccctgacctttaaggaccagttcatcattgcctatggaggacttcgaggtgccatctgttttgcgttagtgtttctccttcctgctgctgtgtttcctcggaaaaaattgtttattacggctgccattgttgtcatattctttactgtcttcattctgggaataactattcgaccactggtggagtttcttgatgtcaagaggtccaataagaaacaacaagctgtcagtgaagaaatctattgtcggttgtttgatcatgtgaagactggaattgaagatgtttgtggacattggggtcacaacttttggagagacaagtttaagaagtttgatgataaatatctgcggaagcttttgattcgggaaaaccaaccaaagtcaagtattgtatctttatataaaaagcttgaaataaaacatgccattgagatggcagagactgggatgataagtactgtccctacatttgcatctctaaatgattgtcgtgaagaaaaaataaggaaggtcacgtccagtgaaactgatgaaattcgagaactcttatcaagaaatctctatcaaatccgtcagcgaactttatcctacaacagacacagtctgacagccgacacaagtgagagacaagccaaggagattctgattcgccggcgacacagtttgcgagaaagcattaggaaggacagcagcttgaatcgagaacacagggcttccacttcaacctcccgatatttatccttacctaaaaatacgaagcttccagaaaagctacaaaagaggaggactatttctattgcagatggcaatagcagcgactcagacgcagatgccgggaccaccgtgctcaatttgcagcccagagccaggcgcttcttgccagaacagttctccaagaaatccccccagtcctataaaatggaatggaagaatgaggtagatgttgattctggccgagatatgcccagcacccccccaacaccccacagcagagaaaagggcacccagacgtcaggcttactacagcagccccttctctctaaagaccagtctggctcagagagggaagacagtttgactgaaggcatcccgcccaagccgccaccacggctggtctggagggcatcggaacctggaagccggaaagcccgatttgggagtgagaagccttaagagaagcagcgaaagcagatctgagtgtctgacccaggacagctgtggtttgtcactctgaaacctgatgcaacagtggaatccatgtaaaactctctgtgcatctaaatacttctggagggcgacagattcatgccacggataaatgaggcaaatccgaagaaaaggaaaatcgaataaaaaatagtcccacaaaataccttttgtgactaatgggtagcaatcgtattatttgctggcctgaagagaaaaaatggtaatgtgtgcctttattgaacttgaatgacagaacttgaaatttttaacacatccttcttggtgaagattttaatatattacttatatgcttcaaattttatttatgaaaaaatatgtatatctgtaatcagttgttaagtgaatggcactaaaagtatcgagaacagctttctttcccaggggtgaaggatggcgctcgggggtgactcctaagctcagcgtggaagcttttccctgtcctgacccgatggagcagccggtaagtgaagagcacagctggaagcagagacaccttatgactcaaactgggcaaacaatcggaacgtcatgcagaaggaatggcctgactcctgcagtgcagattggaggccccagaactcctatgaactactgagagtctactggtttttaacttgttcctctgtctactgtgtgtttgggggtgacatctaaattccatttcttcttcttgtttaaatggtgcagagagaaaggttgcccagacatccaccagcttactgtgttgacagatttgggagcagcttttgatgaagttccacccatgagggtccatgtggcaagtagggccacagggcagcacctggttacaacttgctggtgggttttatgttgtgcaatactaggaggaggaggcaggtgatctatgctgatctatgatcacctgcttcagtagaatttttctgtagagtgttgtttgaattttgagcctccaggttagaggctccaagcagacaaagaagaaagtttgtagacacaatattctaacattgcacaagttgatgagatatcaagttttgaatattattcaggaagcactttggagaatgtgggagtcctactgttttgcactagtctgtaatttgttacctctccccattcgataatatagtaactcagaattttcatataaaattgaattctactcattagagtactttttaaaagtacagcagaaagaaaagaagtggaacataagcattcaagattaatatttgattctctatctcttaactgtagattttattggcctgttttttttttctaaataattctttaaaacttgactggaacatgcctctgcatttctgagtgtagaaattaaatgaagccactcacagtcctttgatttcccactgaagataccccaaaggatgcaagtgcctacagtattatcaggaggagaacatgaaaatattaagacaaaaatcctcagcagttgttctccaccccttctccacctccaccagcaaggagaagtcaatctacacttttttctcatgttctaaagtcttagaatactgctggattgttgagcatgagacagagcaaaggttagatacacaaggtacaagttcataggagcacaattccttgattcagggaaagtagcacagaatgcaatttgaaaactacaggcttaggactctgtgccaaaaatctctattttaaatgaaaatatttatataaaaatacatttattctgcttaacacaaattaaaactgacataaaattttatgataataacatgattcaagaaatgtgatgtagatttttgagaatgccaaaaatcaggtttcagaaaagctacagtatgaaatctgaaaagcaacagaaattgaaagtgaccttaaagaataaatttcctaatttttcccagtttcctatgtttataactattataaagagtttaactttctggaactgaaggagaaaacatgaaaatgtttatattgcttcttgttaagcaggtagaccaaattccgctttcagtaattcatccatacagaatttggatgactatgtataaaggaaaacttaaatcttaattattatcagtttaaattttttttgtttgttgaatgacaaaggcaataaaaataaatttgactttagctttttttctatactttcctctttttgtaattcttaaattctagtcactagtcattatgagagtattgactaaatattttcacaatctaaatattgtcacaatctaaatttctgtagtagagagagccgtagccctttgtaaaggctttcgttcgtccaaacaacacttgatccaaccaaagttccaatgtgactgtggatctttgataggtctttggtgttggttgtaacaaaatttgatttgaactacctataaatgaaaagtcggggtttattactttatatgtaatgctgagaggagactgttgggaacagttatgtcaatgagcaaactagaaattggcttcaaagtctaatacttttaaaagcatgtgttttgtgtatatgctcacaaaatgtctgtgaagagatttctttcagcttttgctcagctttatggtggggtgtactgttttatctgggcggtgagggtattgatttacataaaaactgtagacaaacacagtacgagtctcagcacgttttgcatttattgtactgcccaaattgtttttatgttaaaagtcacgtttcataatctgcaatatttttgtcaaagtgcacactgtactttcttcttaaaaacgtgattaaagagatcactttgtccggatgaa

SEQ ID NO: 29416 - DNA, 2584 bp, Homo sapiens
gcaggcggcaatgtggggactcggggcccggggccccgaccgggggctgctgctggcgctggcgctgggcgggctggcgcgggccgggggcgtcgaggtggagcccggcggcgcgcacggcgagagcgggggcttccaggtggtcaccttcgagtgggcccacgtgcaggatccctacgtcatcgcgctctggatcctcgtggccagcttggccaagatcgggttccacctgtcccacaaggtcaccagcgtggttcccgagagcgccctgctcatcgtgctgggcctggtgctgggcggcatcgtctgggcggccgaccacatcgcgtccttcacactgacgcccaccgtcttcttcttctacctgctgccccccatcgtgctggacgccggctacttcatgcccaaccgcctcttcttcggcaacctggggaccatcctgttgtacgccgtcgtgggtaccgtgtggaacgcggccaccaccgggctgtccctctacggcgtcttcctcagtgggctcatgggcgacctgcagattgggctgctggacttcctcctgtttggcagcctcatggcggctgtggacccggtggccgtcctggccgtgtttgaggaggtccatgtcaacgaggtcctgttcatcatcgtcttcggggagtcgctgctgaacgacgcagtcaccgtggttctgtacaatgtgtttgaatctttcgtggcgctgggaggtgacaacgtgactggcgtggactgcgtgaagggcatagtgtccttcttcgtggtgagcctggggggcacgctggtgggggtggtcttcgccttcctgctgtcgctggtgacgcgcttcaccaagcatgtgcgtatcatcgagcccggcttcgtgttcatcatctcctacctgtcctacctgacgtccgagatgctgtcgctgtcggccatcctcgccatcaccttctgtggcatctgctgtcagaagtatgtgaaggccaacatctcggagcagtcggccaccaccgtgcgctacaccatgaagatgctggccagcagcgccgagaccatcatcttcatgttcctgggtatctcggccgtgaacccgttcatctggacctggaacacggccttcgtgctcctgacgctggtcttcatctccgtgtaccgggccatcggtgtggtcctgcagacctggcttctgaaccgctaccgcatggtgcagctggagcccattgaccaggtggtcctgtcctacgggggcctgcgcggggccgtggcctttgccctggtggtgcttctggatggagacaaggtcaaggagaagaacctgttcgtcagcaccaccatcatcgtagtgttcttcaccgtcatcttccagggcctgaccatcaagcctctggtgcagtggctgaaggtgaagaggagcgagcaccgggaacctcggctcaacgagaagctgcacgggcgcgctttcgaccacatcctctcggccatcgaggacatatccggacagatcgggcacaattatctcagagacaagtggtcccacttcgacaggaagttcctcagcagggtcctcatgagacggtcggcccagaagtctcgagaccggatcctgaatgtcttccacgagctgaacctgaaggatgccatcagctacgtggctgagggagagcgccgcgggtccctggccttcatccgctcccccagcaccgacaacgtggtcaacgtggacttcacgccacgatcgtccaccgtggaggcctctgtctcctacctcctgagagaaaatgtcagcgctgtctgcctggacatgcagtctctggagcagcgacggcggagcatccgggacgcggaggacatggtcacgcaccacacgctacagcagtacctgtacaagccgcggcaggagtacaagcatctgtacagccgacacgagctcacgcccacggaggacgagaaacaggaccgggaaatcttccacaggaccatgcggaagcgcctggagtccttcaagtcgaccaagctggggctcaaccagaacaagaaggcggccaagctgtacaagcgggagcgtgcccagaagcggagaaacagcagcatccccaatgggaagctgcccatggagagccctgcgcagaatttcaccatcaaggagaaagacttggaactttcagacaccgaggagccccccaactatgatgaggagatgagtggggggatcgagttcctggctagtgtcaccaaggacacagcgtccgactcccctgcaggaattgacaaccctgtgttttctccggacgaggccctggaccgcagcctcctggccaggctgccgccctggctgtctcccggggagacggtggtcccctcgcagagggcccgcacgcagattccctactctcccggcaccttctgccgcctgatgcccttccgcctcagcagcaagtccgtggactccttcctgcaggcagacggccccgaggagcggccccccgccgccctccccgagtccacacacatgtgacaccggctccgacacgccgctaaccggccgctcgtccccgcgccacggtccgcccaccgccgccgccgc

SEQ ID NO: 29417 - DNA, 2003 bp, Homo sapiens
gctcagacgccgcgcggggcggggattggtctgtggtcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcagcgcgagcttcggcctcggctctgtaccatgaagaagggccccagtggctatggcttcaacctgcacagcgacaagtccaagccaggccagttcatccggtcagtggacccagactccccggctgaggcttcagggctccgggcccaggatcgcattgtggaggtgaacggggtctgcatggaggggaagcagcatggggacgtggtgtccgccatcagggctggcggggacgagaccaagctgctggtggtggacagggaaactgacgagttcttcaagaaatgcagagtgatcccatctcaggagcacctgaatggtcccctgcctgtgcccttcaccaatggggagatacagaaggagaacagtcgtgaagccctggcagaggcagccttggagagccccaggccagccctggtgagatccgcctccagtgacaccagcgaggagctgaattcccaagacagccccccaaaacaggactccacagcgccctcgtctacctcctcctccgaccccatcctagacttcaacatctccctggccatggccaaagagagggcccaccagaaacgcagcagcaaacgggccccgcagatggactggagcaagaaaaacgaactcttcagcaacctctgagcgccctgctgccacccagtgactggcagggccgagccagcattccaccccacctttttccttctccccaattactcccctgaatcaatgtacaaatcagcacccacatcccctttcttgacaaatgatttttctagagaactatgttcttccctgactttagggaaggtgaatgtgttcccgtcctcccgcagtcagaaaggagactctgcctccctcctcctcactgagtgcctcatcctaccgggtgtccctttgccaccctgcctgggacatcgctggaacctgcaccatgccaggatcatgggaccaggcgagagggcaccctcccttcctcccccatgtgataaatgggtccagggctgatcaaagaactctgactgcagaactgccgctctcagtggacagggcatctgttaccctgagacctgtggcagacacgtcttgttttcatttgatttttgttaagagtgcagtattgcagagtctagaggaatttttgtttccttgattaacatgattttcctggttgttacatccagggcatggcagtggcctcagccttaaacttttgttcctactcccaccctcagcgaactgggcagcacggggagggtttggctacccctgcccatccctgagccaggtaccaccattgtaaggaaacactttcagaaattcagctggttcctccaaacccttc

SEQ ID NO: 29418 - DNA, 1433 bp, Homo sapiens
atgagcgcggacgcagcggccggggcgcccctgccccggctctgctgcctggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcagcgcgagcttcggcctcggctctgtaccatgaagaagggccccagtggctatggcttcaacctgcacagcgacaagtccaagccaggccagttcatccggtcagtggacccagactccccggctgaggcttcagggctccgggcccaggatcgcattgtggaggtgaacggggtctgcatggaggggaagcagcatggggacgtggtgtccgccatcagggctggcggggacggctcaggaggtgggaaccagcgaggagctgaattcccaagacagccccccaaaacaggactccacagcgccctcgtctacctcctcctccgaccccatcctagacttcaacatctccctggccatggccaaagagagggcccaccagaaacgcagcagcaaacgggccccgcagatggactggagcaagaaaaacgaactcttcagcaacctctgagcgccctgctgccacccagtgactggcagggccgagccagcattccaccccacctttttccttctccccaattactcccctgaatcaatgtacaaatcagcacccacatcccctttcttgacaaatgatttttctagagaactatgttcttccctgactttagggaaggtgaatgtgttcccgtcctcccgcagtcagaaaggagactctgcctccctcctcctcactgagtgcctcatcctaccgggtgtccctttgccaccctgcctgggacatcgctggaacctgcaccatgccaggatcatgggaccaggcgagagggcaccctcccttcctcccccatgtgataaatgggtccagggctgatcaaagaactctgactgcagaactgccgctctcagtggacagggcatctgttaccctgagacctgtggcagacacgtcttgttttcatttgatttttgttaagagtgcagtattgcagagtctagaggaatttttgtttccttgattaacatgattttcctggttgttacatccagggcatggcagtggcctcagccttaaacttttgttcctactcccaccctcagcgaactgggcagcacggggagggtttggctacccctgcccatccctgagccaggtaccaccattgtaaggaaacactttcagaaattcagctggttcctcc

SEQ ID NO: 29419 - DNA, 2174 bp, Homo sapiens
gaggcgacgggagccgaacaggagccgccgctgaagccaccgccgggtgcccagcgccgccgccgcccccgagctcccccgcgcccctgcccgcgggcggccggtgggcagcgggcgccatggccgcgccggagccgctgcggccgcgcctgtgccgcttggtgcgcggagagcagggctacggcttccacctgcacggcgagaagggccgccgcgggcagttcatccggcgcgtggaacccggttcccccgccgaggccgccgcgctgcgcgctggggaccgcctggtcgaggtcaacggcgtcaacgtggagggcgagacgcaccaccaggtggtgcaaaggatcaaggctgtggaggggcagactcggctgctggtggtggaccaggagacagatgaggagctccgccggcggcagctgacctgtaccgaggagatggcccagcgagggctcccacccgcccacgacccctgggagccgaagccagactgggcacacaccggcagccacagctccgaagctggcaagaaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggatggcagtgcctggaagcaagatcccttccaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagacccccccccttcccctcccccttcccctcccccttgggacgcgctctaaataattgcaataaaacaaacctttctctgcaaaccatttcctccccgccccctcccctcagcagcggccgtcctgagtgggagtccctgggacttcccagtggccaagttggggcgcccagcctcttcgtggggaccttgggtaaggccagggaggcctgatgtggccgtaggagctgcccctgcccacctgccctggtgtgggggtccctaggccacaccctgctccccacccagctaccctgtgcgcctgtgccctgctgggggcctgggctctccgaggggcctgaggatggaggccccacgtccccgaggagggcggcctctggacaggcccctcattccgcgcggcagctcccaggcctggggaacgtaggtgtgtgagagcggcacccgggaaggacgcctggcctctggctcagccctgcttggcgggctcccccgtggacaccctgttgactttgcacttccctcccgggccccgcacccccgaaccgaccaccgatcgaccggcaccgctgttgcctcgtaagccatagcgcatgcgcgctctcaggataaacaggccctgcctggg

SEQ ID NO: 29420 - DNA, 2141 bp, Homo sapiens
gaggcgacgggagccgaacaggagccgccgctgaagccaccgccgggtgcccagcgccgccgccgcccccgagctcccccgcgcccctgcccgcgggcggccggtgggcagcgggcgccatggccgcgccggagccgctgcggccgcgcctgtgccgcttggtgcgcggagagcagggctacggcttccacctgcacggcgagaagggccgccgcgggcagttcatccggcgcgtggaacccggttcccccgccgaggccgccgcgctgcgcgctggggaccgcctggtcgaggtcaacggcgtcaacgtggagggcgagacgcaccaccaggtggtgcaaaggatcaaggctgtggaggggcagactcggctgctggtggtggaccaggagacagatgaggagctccgccggcggcagctgacctgtaccgaggagatggcccagcgagggctcccacccgcccacgacccctgggagccgaagccagactgggcacacaccggcagccacagctccgaagctggcaagaaggatgtcagtgggcccctgagggagctgcgccctcggctctgccacctgcgaaagggacctcagggctatgggttcaacctgcatagtgacaagtcccggcccggccagtacatccgctctgtggacccgggctcacctgccgcccgctctggcctccgcgcccaggaccggctcattgaggtgaacgggcagaatgtggagggactgcgccatgctgaggtggtggccagcatcaaggcacgggaggacgaggcccggctgctggtcgtggaccccgagacagatgaacacttcaagcggcttcgggtcacacccaccgaggagcacgtggaaggtcctctgccgtcacccgtcaccaatggaaccagccctgcccagctcaatggtggctctgcgtgctcgtcccgaagtgacctgcctggttccgacaaggacactgaggagagcggcctccacctgagccccacggcggccgaggccaaggagaaggctcgagccatgcgagtcaacaagcgcgcgccacagatggactggaacaggaagcgtgaaatcttcagcaacttctgagccccttcctgcctgtctcgggaccctgggacccctcccgcacggaccttgggcctcagcctgccccgagctcccccagcctcagtggactggagggtggtcctgccattgcccagaaatcagccccagccccggtgagcccccatcctgcccctgcccaccaggtactgggggcctgtggcagcaagatagggggagagagacccagagatgtgagagagagtcagagacagagacagagagagagagagagagacacagagagagacagagagagagcgagcgagcgcgcggcagccgcggggcgagggcctttgctgctctgccggggcctgctgactgaaaggaatttgtgtttttgctttttttccaaaaagatctccagctccacacatgtttccacttaataccagagacccccccccttcccctcccccttcccctcccccttgggacgcgctctaaataattgcaataaaacaaacctttctctgcaaaccatttcctccccgccccctcccctcagcagcggccgtcctgagtgggagtccctgggacttcccagtggccaagttggggcgcccagcctcttcgtggggaccttgggtaaggccagggaggcctgatgtggccgtaggagctgcccctgcccacctgccctggtgtgggggtccctaggccacaccctgctccccacccagctaccctgtgcgcctgtgccctgctgggggcctgggctctccgaggggcctgaggatggaggccccacgtccccgaggagggcggcctctggacaggcccctcattccgcgcggcagctcccaggcctggggaacgtaggtgtgtgagagcggcacccgggaaggacgcctggcctctggctcagccctgcttggcgggctcccccgtggacaccctgttgactttgcacttccctcccgggccccgcacccccgaaccgaccaccgatcgaccggcaccgctgttgcctcgtaagccatagcgcatgcgcgctctcaggataaacaggccctgcctggg

SEQ ID NO: 29421 - DNA, 4138 bp, Homo sapiens
agacagggaaggtttcctttcctcattagaaggactccagtgatctgtggaatgagcactacagtatccttttaaattttcacccacaagacaaagccagtatgcagtgaaatgaggaaatgcctttaagtgaagagatttttatttctttcataaattgctcaagccatgattggatggaggtcctccaggtagctccatggactttaacaagtctattgaataactgcatttgagttggaagctgagttgcctgaacacaaacgatttaaaccagattagaaagtgtctacatacagagctcaataacacactcggaatcttcttgggaggacccacagactgtacctatattacttttgacccaggtggatgcagtcactctctagaagcctccccgacttcagatgtgtggcacacatccacacaggggtgtaggtaggagaagcccacaggaatggctctgcagatgttcgtgacttacagtccttggaattgtttgctactgctagtggctcttgagtgttctgaagcatcttctgatttgaatgaatctgcaaattccactgctcagtatgcatctaacgcttggtttgctgctgccagctcagagccagaggaagggatatctgtttttgaactggattatgactatgtgcaaattccttatgaggtcactctctggatacttctagcatcccttgcaaaaataggcttccacctctaccacaggctgccaggcctcatgccagaaagctgcctcctcatcctggtgggggcgctggtgggcggcatcatcttcggcaccgaccacaaatcgcctccggtcatggactccagcatctacttcctgtatctcctgccacccatcgttctggagggcggctacttcatgcccacccggcccttctttgagaacatcggctccatcctgtggtgggcagtattgggggccctgatcaacgccttgggcattggcctctccctctacctcatctgccaggtgaaggcctttggcctgggcgacgtcaacctgctgcagaacctgctgttcggcagcctgatctccgccgtggacccagtggccgtgctagccgtgtttgaggaagcgcgcgtgaacgagcagctctacatgatgatctttggggaggccctgctcaatgatggcattactgtggtcttatacaatatgttaattgcctttacaaagatgcataaatttgaagacatagaaactgtcgacattttggctggatgtgcccgattcatcgttgtggggcttggaggggtattgtttggcatcgtttttggatttatttctgcatttatcacacgtttcactcagaatatctctgcaattgagccactcatcgtcttcatgttcagctatttgtcttacttagctgctgaaaccctctatctctccggcatcctggcaatcacagcctgcgcagtaacaatgaaaaagtacgtggaagaaaacgtgtcccagacatcatacacgaccatcaagtacttcatgaagatgctgagcagcgtcagcgagaccttgatcttcatcttcatgggtgtgtccactgtgggcaagaatcacgagtggaactgggccttcatctgcttcaccctggccttctgccaaatctggagagccatcagcgtatttgctctcttctatatcagtaaccagtttcggactttccccttctccatcaaggaccagtgcatcattttctacagtggtgttcgaggagctggaagtttttcacttgcatttttgcttcctctgtctctttttcctaggaagaaaatgtttgtcactgctactctagtagttatatactttactgtatttattcagggaatcacagttggccctctggtcaggtacctggatgttaaaaaaaccaataaaaaagaatccatcaatgaagagcttcatattcgtctgatggatcacttaaaggctggaatcgaagatgtgtgtgggcactggagtcactaccaagtgagagacaagtttaagaagtttgatcatagatacttacggaaaatcctcatcagaaagaacctacccaaatcaagcattgtttctttgtacaagaagctggaaatgaagcaagccatcgagatggtggagactgggatactgagctctacagctttctccataccccatcaggcccagaggatacaaggaatcaaaagactttcccctgaagatgtggagtccataagggacattctgacatccaacatgtaccaagttcggcaaaggaccctgtcctacaacaaatacaacctcaaaccccaaacaagtgagaagcaggctaaagagattctgatccgccgccagaacaccttaagggagagcatgaggaaaggtcacagcctgccctggggaaagccggctggcaccaagaatatccgctacctctcctacccctacgggaatcctcagtctgcaggaagagacacaagggctgctgggttctcagatgatgacagcagtgatccaggatccccatccatcacgttcagcgcatgctctcggatagggtcacttcagaagcaagaggcacaagaaataataccaatgaagagcctacacagaggaaggaaggcattcagctttggttatcaaagaaacacaagccaagaagagtacttgggtggagtaaggagggtggccttaagacccaaacctctgtttcatgcagtggatgaggagggtgagtctggaggggagagtgagggcaaggcctctttggttgaggttcggtcgaggtggacagctgaccatggacacggcagggaccatcacaggtcccatagtcctttgctccaaaaaaaatagtgttattgtccacaagattgttttggtgtttctcaagagtctgtcttcctataactgtgaaaggaggatttctggaattcagaagagagctattgagtttgctgtgttgaagctattaaacatggatctataagcagcaggaagattttttccaaggactgggagcaaacttgcaggctctgccatgtacttattgtggggtacctttagatgaattccctgtgagtgagagaagttgatcaccccaggaattagtcactaagaattcctaagaactttctatcaaaagcattggatccaagccatatattgaaatacaagcgtgattaatcagtaattcacattgccgatatgcatatgcaacttataatcaaatagaactagaagagactttgaagtcacctgactcagccccttgtgtttacagacaaggacatgtagtccaaggttgcatggtgagttcacagtcggattgtcctccctccaaactgaaactaatttgattttgatttcatattcaatatgcaataattatgttctatcagagataaaatttgttatgaatttgctttatttaatcagtagcaatgatagatgtgatgcatactataggattaatctgtgaacaatgggtttacggtctatttcataattgaaatatttattttaaaaatgaatattagaaacaaaacagccataaacagagtttaatagcaatgatgttaacaacaagtatttataaggggtgcatttgtagggtgtgacattttaccctagggtataaaactatttttcttttattattattattattattattatactttaagttttagggtacatgtgcacattgtgcaggttagttacatatgtatacatgtgccatgctggtgtgctgcacccgctaactcgtcatctagcattaggtgtatctcccaatgctatccctcccccctccccccaccccacaacagtccccagagtgtgatgttccccttcctgtgtccatgtgatctcattgttcaattcccacctatgagtgagaatatgcggtgtttggttttttgttcttgggatagtttactgagaatgatgatttccaatttcatccatgtccctacaaaggacatgaactcatcattttttatggctgcatggtattccatggtgtatatgtgccacattttcttaatccagtctatcattgttggacatttgggttggttccaagtctttgctattgtgaataatgccgcaataaacatacgtgtgcatgtgtcttta

SEQ ID NO: 29422 - DNA, 3734 bp, Homo sapiens
ggcggcggcgacgcggggccggcggccgtgcggtgccgggagggcggctgggcaggcggcaggatgctgcgcgccgccctgtccctgctcgcgctgcccctggcgggggcggccgaagagcccacccagaagccagagtccccgggcgagcctcccccaggcttagagctcttccgctggcagtggcacgaggtggaggcgccctacctggtggccctgtggatcctggtggccagtctggccaaaatcgtgtttcacctgtctcggaaagtaacatctctggtccctgagagctgcctgctgattttgctgggcctggtgctagggggaattgttttggctgtggccaagaaagctgagtaccagctggagccaggcaccttcttcctcttcctgctgcctcctattgtgttggactcaggctatttcatgcctagcaggctgttctttgacaacttgggtgccatcctcacctatgccgtggtaggcacactctggaatgccttcacaacaggcgctgccctctggggcttgcagcaggctggacttgtagcccctagggtgcaggctggcttactggacttcctgctgtttgggagcctcatctcggcggtggaccccgtggccgtgctagctgtctttgaggaggtgcacgtcaatgagactctctttatcatcgtctttggcgagtccctgctcaacgatgctgtcaccgtggtgctgtacaaggtctgcaactcctttgtggagatgggctctgccaatgtgcaggccactgactacctgaagggagtcgcctccctgtttgtggtcagtctgggcggggcagccgtgggcttagtctttgccttcctcctggccctgaccacacgcttcaccaagcgggtccgcatcatcgagccgctgctggtcttcctcctcgcctacgcagcctacctcactgctgaaatggcctcgctctccgccattcttgcggtgaccatgtgtggcctgggctgtaagaagtacgtggaggccaacatctcccataagtcacgcacaactgtcaaatatacaatgaagactctagccagctgtgctgagaccgtgatcttcatgctgcttggcatctcagccgtggactcttctaagtgggcctgggattctgggctggtgctgggcaccctcatcttcatcctgttcttccgagccctcggcgtagtcctgcagacctgggtgctgaatcagttccggctagtccctctggacaagattgaccaagtggtgatgtcctatgggggcctgcggggggctgtggcctttgctctcgtcatcctactggataggaccaaggtccctgccaaggactactttgtagccaccactattgtagtggtcttcttcacagtcatcgtgcagggcttgaccatcaagccactggtcaaatggctgaaggtgaagaggagtgagcatcacaaacccaccctgaaccaggagctgcatgaacacacttttgaccacattctggctgcagtggaggacgttgtggggcaccatggctaccactactggagggacaggtgggagcagtttgacaagaaatacctgagtcagctgctgatgcgacgatcagcctaccgcatccgggaccagatctgggatgtgtactacaggcttaacatccgggatgccatcagctttgtggaccagggaggccacgtcttgtcttccacaggtctcactctgccttctatgcccagccgcaattctgtggcagaaacttctgtcaccaacctgctgagggagagtggcagtggagcgtgtctggatctgcaggtgattgacacagtacgcagcggccgggatcgtgaggatgctgtgatgcatcatctgctctgcggaggcctctacaagccgcgccgtaggtacaaagccagctgcagtcgccacttcatctcagaggatgcgcaggagcggcaggacaaggaggtcttccagcagaacatgaagcggcggctggagtcctttaagtccaccaagcacaacatctgcttcaccaagagcaagccacgaccccgcaagactggccgcaggaagaaggatggtgtggcgaatgctgaggctacaaatgggaaacatcgaggcctgggctttcaggacacagctgctgtgatattaaccgtggagtctgaggaggaggaggaggagagcgacagttcagagacagagaaggaggacgatgaggggatcatctttgtggctcgtgccaccagtgaggttctccaagagggcaaggtctcaggaagccttgaggtgtgcccaagcccacgaatcattcccccctccccaacctgtgcagaaaaggagctcccctggaagagtgggcagggggacctggcagtgtacgtgtcctcggaaaccaccaagattgtgcctgtggacatgcagacgggttggaaccagagcatctcatccctggagagcctagcgtcccctccctgtaaccaggccccaattctgacctgcctgcctccccatccacggggcactgaagagccccaggtccctctccacctaccttctgatccacgctctagcttcgccttcccaccgagcctggccaaggctggccgctctcgcagtgagagcagcgctgacctcccccagcagcaggagctgcagcccctcatgggccacaaggaccacacccatctcagcccaggcaccgctacctcccactggtgcatccagttcaacagaggcagccggctgtagctcaaggcctcggggaggagcaggaggtggaatccctgtgggaagtgctccctgggtgatgggtagagccctcgaaacttgacatggggccagaagggcctgggttgaagtagtaattgggcttccttggagctagtcagaggggtcacctaagctggtcctcacaggggcctttctcaccacctccctgctcctaacccctgccactttctgtttcattaaggcctctactctggctcaggacccagtccaggccttctacgggctaggcccagagacttgggttgctggtcccccttccctagtgggttttcccggggactctataggcagctgctcctgcccgcaaagcaagagcatcattcctattcttcagtggatgccagccttccctgccccaactccctccccagcactgggtcagtggtgtcctggcagtgaggctccgtgaggggctggcccttagaggaactggggtgggaggtggggcaggcctcacccttgggctttgctgccctgttgggtcagctacccatagtccatttttttagggcagtgggaacctctgcctccacttcctgctttagccccttccctttgctgccaggtattggggtaatatttcctccttttccaagaccaaggccaagaggctgggccaggcttcagttcaggcctgttgcttaactggggtcaccctgggatctgctgctctgggtctaagtctagacctttctgatccttgggtctgggttttttgaggaggggacatagtggcctctgggctgccatgtcaccacctgaacattccccaaacagagaaggaacccagcatctcagggccactgctccattgctctgggggctgggatgcctggctaagcaggggctgacagggtggcaggtgactttctagggatcagcacctgccctgtgttttgtaccttgaacctaagatatattaaacatctctcagatgg

SEQ ID NO: 29423 - DNA, 3805 bp, Homo sapiens
ggcggcggcgacgcggggccggcggccgtgcggtgccgggagggcggctgggcaggcggcaggatgctgcgcgccgccctgtccctgctcgcgctgcccctggcgggggcggccgaagagcccacccagaagccagagtccccgggcgagcctcccccaggcttagagctcttccgctggcagtggcacgaggtggaggcgccctacctggtggccctgtggatcctggtggccagtctggccaaaatcgtgtttcacctgtctcggaaagtaacatctctggtccctgagagctgcctgctgattttgctgggcctggtgctagggggaattgttttggctgtggccaagaaagctgagtaccagctggagccaggcaccttcttcctcttcctgctgcctcctattgtgttggactcaggctatttcatgcctagcaggctgttctttgacaacttgggtgccatcctcacctatgccgtggtaggcacactctggaatgccttcacaacaggcgctgccctctggggcttgcagcaggctggacttgtagcccctagggtgcaggctggcttactggacttcctgctgtttgggagcctcatctcggcggtggaccccgtggccgtgctagctgtctttgaggaggtgcacgtcaatgagactctctttatcatcgtctttggcgagtccctgctcaacgatgctgtcaccgtggtgctgtacaaggtctgcaactcctttgtggagatgggctctgccaatgtgcaggccactgactacctgaagggagtcgcctccctgtttgtggtcagtctgggcggggcagccgtgggcttagtctttgccttcctcctggccctgaccacacgcttcaccaagcgggtccgcatcatcgagccgctgctggtcttcctcctcgcctacgcagcctacctcactgctgaaatggcctcgctctccgccattcttgcggtgaccatgtgtggcctgggctgtaagaagtacgtggaggccaacatctcccataagtcacgcacaactgtcaaatatacaatgaagactctagccagctgtgctgagaccgtgatcttcatgctgcttggcatctcagccgtggactcttctaagtgggcctgggattctgggctggtgctgggcaccctcatcttcatcctgttcttccgagccctcggcgtagtcctgcagacctgggtgctgaatcagttccggctagtccctctggacaagattgaccaagtggtgatgtcctatgggggcctgcggggggctgtggcctttgctctcgtcatcctactggataggaccaaggtccctgccaaggactactttgtagccaccactattgtagtggtcttcttcacagtcatcgtgcagggcttgaccatcaagccactggtcaaatggctgaaggtgaagaggagtgagcatcacaaacccaccctgaaccaggagctgcatgaacacacttttgaccacattctggctgcagtggaggacgttgtggggcaccatggctaccactactggagggacaggtgggagcagtttgacaagaaatacctgagtcagctgctgatgcgacgatcagcctaccgcatccgggaccagatctgggatgtgtactacaggcttaacatccgggatgccatcagctttgtggaccagggaggccacgtcttgtcttccacaggtctcactctgccttctatgcccagccgcaattctgtggcagaaacttctgtcaccaacctgctgagggagagtggcagtggagcgtgtctggatctgcaggtgattgacacagtacgcagcggccgggatcgtgaggatgctgtgatgcatcatctgctctgcggaggcctctacaagccgcgccgtaggatagagctgaggacagagccctgtggcatgctactaaagactttcctccagactgacatggatcaagcatttttgggtacaaagccagctgcagtcgccacttcatctcagaggatgcgcaggagcggcaggacaaggaggtcttccagcagaatgaagcggcggctggagtcctttaagtccaccaagcacaacatctgcttcaccaagagcaagccacgaccccgcaagactggccgcaggaagaaggatggtgtggcgaatgctgaggctacaaatgggaaacatcgaggcctgggctttcaggacacagctgctgtgatattaaccgtggagtctgaggaggaggaggaggagagcgacagttcagagacagagaaggaggacgatgaggggatcatctttgtggctcgtgccaccagtgaggttctccaagagggcaaggtctcaggaagccttgaggtgtgcccaagcccacgaatcattcccccctccccaacctgtgcagaaaaggagctcccctggaagagtgggcagggggacctggcagtgtacgtgtcctcggaaaccaccaagattgtgcctgtggacatgcagacgggttggaaccagagcatctcatccctggagagcctagcgtcccctccctgtaaccaggccccaattctgacctgcctgcctccccatccacggggcactgaagagccccaggtccctctccacctaccttctgatccacgctctagcttcgccttcccaccgagcctggccaaggctggcctcgcagtgagagcagcgctgacctcccccagcagcaggagctgcagcccctcatgggccacaaggaccacacccatctcagcccaggcaccgctacctcccactggtgcatccagttcaacagaggcagccggctgtagctcaaggcctcggggaggagcaggaggtggaatccctgtgggaagtgctccctgggtgatgggtagagccctcgaaacttgacatggggccagaagggcctgggttgaagtagtaattgggcttccttggagctagtcagaggggtcacctaagctggtcctcacaggggcctttctcaccacctccctgctcctaacccctgccactttctgtttcattaaggcctctactctggctcaggacccagtccaggccttctacgggctaggcccagagacttgggttgctggtcccccttccctagtgggttttcccggggactctataggcagctgctcctgcccgcaaagcaagagcatcattcctattcttcagtggatgccagccttccctgccccaactccctccccagcactgggtcagtggtgtcctggcagtgaggctccgtgaggggctggcccttagaggaactggggtgggaggtggggcaggcctcacccttgggctttgctgccctgttgggtcagctacccatagtccatttttttagggcagtgggaacctctgcctccacttcctgctttagccccttccctttgctgccaggtattggggtaatatttcctccttttccaagaccaaggccaagaggctgggccaggcttcagttcaggcctgttgcttaactggggtcaccctgggatctgctgctctgggtctaagtctagacctttctgatccttgggtctgggttttttgaggaggggacatagtggcctctgggctgccatgtcaccacctgaacattccccaaacagagaaggaacccagcatctcagggccactgctccattgctctgggggctgggatgcctggctaagcaggggctgacagggtggcaggtgactttctagggatcagcacctgccctgtgttttgtaccttgaacctaagatatattaaacatctctcagatgg

SEQ ID NO: 29424 - DNA, 4681 bp, Homo sapiens
cgccggtgaggtaggggcgggaggcggggggagacatggctcggcgcggctggcggcgggcacccctccgccgtggcgtcggcagcagtccccgagcccgcaggctcatgcggcccctttggttgctcctcgcagtgggcgtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggtcttttggtgggccttgtgcttcggtatggcattcatgttccgagtgatgtaaataatgtgaccctgagctgtgaagtgcagtcaagtccaactaccttactggtaaatgttagtggaaaattttatgagtatatgctgaaaggagagattagttcacatgaactcaataatgttcaagataatgaaatgcttagaaaggttacttttgatccagaagtatttttcaacatattacttcctcctatcatattttatgcaggttatagcctgaaaaggagacatttttttcgaaatcttgggtctatcctagcatacgcttttcttggaacagcaatttcttgtttcgttattgggtcaataatgtatggctgtgtaacgctgatgaaggtaacgggacaacttgcaggagatttttactttacagattgcctactgtttggtgccattgtatcagcaactgatccagtgactgttcttgctatattccacgagcttcaagttgatgttgaactctatgcacttctttttggtgaaagtgtcctcaatgatgctgttgccatagtgctgtcctcctcaatagtggcataccagccagctggagacaacagtcacacctttgatgtcacagcgatgttcaagtctattgggatcttccttggaatcttcagtggatcttttgcaatgggtgctgctactggagtggtgacagctttagtgacaaagttcaccaaattacgggagttccagttgttggagacaggcctgttcttcttgatgtcctggagtaccttcctcttggctgaagcatggggcttcacaggtgtagttgcagtattgttttgtggcatcacacaagcacattatacgtataataatttgtccacggagtctcagcatagaactaaacagttgtttgagcttctcaatttcttggcagagaatttcatcttctcctacatggggctgacactgttcaccttccagaaccatgtctttaacccaacatttgtagtaggagcatttgttgctattttcttgggaagagctgccaatatttaccccttgtccctcttacttaatttgggtagaagaagtaagattggatcaaattttcaacacatgatgatgtttgctggccttcgtggtgcaatggcatttgccttggccattcgagatactgccacttatgcacggcaaatgatgttcagcaccacgcttctgattgtgttttttaccgtgtgggtatttggtggtggcaccactgcaatgctgtcatgcttgcatatcagggttggtgttgattcagaccaagaacacttgggtgttcctgaaaatgaaaggagaactaccaaagcagagagtgcttggcttttccggatgtggtacaactttgatcataactatctgaagcctctgctgacccacagcgggcctccgctgacaacaacactccctgcctgctgtggacccatcgccaggtgcctcaccagcccccaggcttacgaaaaccaggaacagttgaaagatgatgattctgatcttattctcaatgatggtgacatcagtttgacatatggagattctactgtgaacactgaaccggccacatccagcgccccaaggagatttatgggaaacagttctgaagatgccttggatcgggagcttgcatttggggaccatgaactggtcattcgaggaacacgcctggttcttccaatggatgattctgaacccccgctaaatttgttagataatacgagacatggtccagcctaagcttactaatactcacttagtgatttgtaaaatttgcacatgtgattgtgaagaaatttgtactacctaaaagtcccagtgcatgtctctgaatgtgtaagctatataaatgctatttatatggcatagaaagaatataaatatcctgtacacggcagattgtgaacaaactatattcctttaagttttcctggttgcactctgtagactggatctgttttaggaagttactttcacagtgatgttgtgtgttctgttagttttatgtctcagttaaagtgtaaaaagtgacggattttctctttcttaaacttacctgacacttaaccagagtaccagttctcgtgatgtgaattaatttttttgtgtgctaggggagggagagtgaggagggagtgttatttccttgggaacctagggaggagaggttcctttgttgggaaacttttgttgatagctgctgcctttgtcctgatcgttttctttcccttttctctggtggcctgttgtggtgcaacgagctgatggcatttgatcttgccccattcaggttggggagtgaagtgtgaggacccttttcccccgcttgctgtgaaagcacagattcattgactacagtacactgttgttcagaaaagaaggctgcaaatgacttctgagactttatgtcttttcttccagaccaagaccgtagaaggagtcacatctagccggcttagccaaagtacaggtgtatatagttcagggcacttgatttagatttggaggggctggggtgggcagagagcaagaggcgagtaaagagaatggtggtttcagagatctctcttcccaaatgtgtaaatattctataccagataagtttaaataagaaatttaattgctgcttaatttttgattatgtactttatctgtatagcaggctttgtcgtcagaagtttttatatcgatttaaattgctgctctttagcagccaaacaggagcaaaatgtaaaatttttgaacttactgtgtctaatcatcatttgttagtctgtagttaatgtcaacagttaatttatgaacccacgatcgttccacactgcaccaaagtcagtcataagagaaatcgaatattctggagcactgattgcagcagggtggctcctttgtgtgcagcaggtgtagtagtcttcattttcatggtacgttttaatattaattacctaagctgccatgcatttttttttttacagttctcaaggaagagcacagaacaatttctcatttcatatttggagtatgaaagtagattctattttgtaatgctgataatacctaaagatgcattgaatgcttggaagaatgctttttgatgttgattttgacctgttcatgattcagaagaaaaacaaacttttttggattttttttccctcaggtctgagtagcattgccttaaatcttatccagttagaacattgatttatttacatgatgttcagattttccagtgaaaaatacccttctgaacaaaacatgtacttactctccgaaaggcatctatctgtgctattgcaaacactccttgagattttaggggaattctaatgttgtaccctttcgtggcagctttgactgttggcatagccatttgttatgtagtggtagcgactttcctgctatgcaggaatccctcccatgacgtgtatgttttacatgatgtgtgcctcttcacgcagtaaatagtttcttgttaatgtatgtttgaggagtttgaacgtcagtgtcacttacccacaaagttattcaagttgtaaaaggttatacaataatttaacaactaccttttttattctgtcgggttactgacctcactttatgtaaatacttcgcatgacaaattcagtaactcgtctatttcagcatgcataagacttttcactagggaaactgataaagcttgagtcaactaaatctgccttcatactttatcaaggggaaccaagcctgctgtgcttacatcagcatctggaagactttcctctcctctaatctgtgtacacatctccaagcaaggaagaaaaaacaaactctgctcagacgcctatgaaacacctgaatgaactttgatgaagtacagtctgagttaccatcatgcacaagtagaactgctcttggacttgttttcctgttgtttgtggaacctacgcgtttgaatggcttgaacgttgcatcttttaaagttattttttaaggtttcttggcatttatcctagttgtccgtgtttggcaatgtgctgttaaagtaatagacttttaatctttatgtattttttgttttctctggagtacttggacagatgttatagtggtttcttttaggaaaatctgtcattaaaaaagttatagccttgcaaataaccactcacagtatttgagtcacagtttattttagtgagacgtaaagagtgctgacttcatttatttttctacctatatacctagtggaaaaggggaagactaatgttttcaaataaacaaacagaaacctaacagaa

SEQ ID NO: 29425 - DNA, 4585 bp, Homo sapiens
cgccggtgaggtaggggcgggaggcggggggagacatggctcggcgcggctggcggcgggcacccctccgccgtggcgtcggcagcagtccccgagcccgcaggctcatgcggcccctttggttgctcctcgcagtgggcgtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggtcttttggtgggccttgtgcttcggtatggcattcatgttccgagtgatgtaaataatgtgaccctgagctgtgaagtgcagtcaagtccaactaccttactggttacttttgatccagaagtatttttcaacatattacttcctcctatcatattttatgcaggttatagcctgaaaaggagacatttttttcgaaatcttgggtctatcctagcatacgcttttcttggaacagcaatttcttgtttcgttattgggtcaataatgtatggctgtgtaacgctgatgaaggtaacgggacaacttgcaggagatttttactttacagattgcctactgtttggtgccattgtatcagcaactgatccagtgactgttcttgctatattccacgagcttcaagttgatgttgaactctatgcacttctttttggtgaaagtgtcctcaatgatgctgttgccatagtgctgtcctcctcaatagtggcataccagccagctggagacaacagtcacacctttgatgtcacagcgatgttcaagtctattgggatcttccttggaatcttcagtggatcttttgcaatgggtgctgctactggagtggtgacagctttagtgacaaagttcaccaaattacgggagttccagttgttggagacaggcctgttcttcttgatgtcctggagtaccttcctcttggctgaagcatggggcttcacaggtgtagttgcagtattgttttgtggcatcacacaagcacattatacgtataataatttgtccacggagtctcagcatagaactaaacagttgtttgagcttctcaatttcttggcagagaatttcatcttctcctacatggggctgacactgttcaccttccagaaccatgtctttaacccaacatttgtagtaggagcatttgttgctattttcttgggaagagctgccaatatttaccccttgtccctcttacttaatttgggtagaagaagtaagattggatcaaattttcaacacatgatgatgtttgctggccttcgtggtgcaatggcatttgccttggccattcgagatactgccacttatgcacggcaaatgatgttcagcaccacgcttctgattgtgttttttaccgtgtgggtatttggtggtggcaccactgcaatgctgtcatgcttgcatatcagggttggtgttgattcagaccaagaacacttgggtgttcctgaaaatgaaaggagaactaccaaagcagagagtgcttggcttttccggatgtggtacaactttgatcataactatctgaagcctctgctgacccacagcgggcctccgctgacaacaacactccctgcctgctgtggacccatcgccaggtgcctcaccagcccccaggcttacgaaaaccaggaacagttgaaagatgatgattctgatcttattctcaatgatggtgacatcagtttgacatatggagattctactgtgaacactgaaccggccacatccagcgccccaaggagatttatgggaaacagttctgaagatgccttggatcgggagcttgcatttggggaccatgaactggtcattcgaggaacacgcctggttcttccaatggatgattctgaacccccgctaaatttgttagataatacgagacatggtccagcctaagcttactaatactcacttagtgatttgtaaaatttgcacatgtgattgtgaagaaatttgtactacctaaaagtcccagtgcatgtctctgaatgtgtaagctatataaatgctatttatatggcatagaaagaatataaatatcctgtacacggcagattgtgaacaaactatattcctttaagttttcctggttgcactctgtagactggatctgttttaggaagttactttcacagtgatgttgtgtgttctgttagttttatgtctcagttaaagtgtaaaaagtgacggattttctctttcttaaacttacctgacacttaaccagagtaccagttctcgtgatgtgaattaatttttttgtgtgctaggggagggagagtgaggagggagtgttatttccttgggaacctagggaggagaggttcctttgttgggaaacttttgttgatagctgctgcctttgtcctgatcgttttctttcccttttctctggtggcctgttgtggtgcaacgagctgatggcatttgatcttgccccattcaggttggggagtgaagtgtgaggacccttttcccccgcttgctgtgaaagcacagattcattgactacagtacactgttgttcagaaaagaaggctgcaaatgacttctgagactttatgtcttttcttccagaccaagaccgtagaaggagtcacatctagccggcttagccaaagtacaggtgtatatagttcagggcacttgatttagatttggaggggctggggtgggcagagagcaagaggcgagtaaagagaatggtggtttcagagatctctcttcccaaatgtgtaaatattctataccagataagtttaaataagaaatttaattgctgcttaatttttgattatgtactttatctgtatagcaggctttgtcgtcagaagtttttatatcgatttaaattgctgctctttagcagccaaacaggagcaaaatgtaaaatttttgaacttactgtgtctaatcatcatttgttagtctgtagttaatgtcaacagttaatttatgaacccacgatcgttccacactgcaccaaagtcagtcataagagaaatcgaatattctggagcactgattgcagcagggtggctcctttgtgtgcagcaggtgtagtagtcttcattttcatggtacgttttaatattaattacctaagctgccatgcatttttttttttacagttctcaaggaagagcacagaacaatttctcatttcatatttggagtatgaaagtagattctattttgtaatgctgataatacctaaagatgcattgaatgcttggaagaatgctttttgatgttgattttgacctgttcatgattcagaagaaaaacaaacttttttggattttttttccctcaggtctgagtagcattgccttaaatcttatccagttagaacattgatttatttacatgatgttcagattttccagtgaaaaatacccttctgaacaaaacatgtacttactctccgaaaggcatctatctgtgctattgcaaacactccttgagattttaggggaattctaatgttgtaccctttcgtggcagctttgactgttggcatagccatttgttatgtagtggtagcgactttcctgctatgcaggaatccctcccatgacgtgtatgttttacatgatgtgtgcctcttcacgcagtaaatagtttcttgttaatgtatgtttgaggagtttgaacgtcagtgtcacttacccacaaagttattcaagttgtaaaaggttatacaataatttaacaactaccttttttattctgtcgggttactgacctcactttatgtaaatacttcgcatgacaaattcagtaactcgtctatttcagcatgcataagacttttcactagggaaactgataaagcttgagtcaactaaatctgccttcatactttatcaaggggaaccaagcctgctgtgcttacatcagcatctggaagactttcctctcctctaatctgtgtacacatctccaagcaaggaagaaaaaacaaactctgctcagacgcctatgaaacacctgaatgaactttgatgaagtacagtctgagttaccatcatgcacaagtagaactgctcttggacttgttttcctgttgtttgtggaacctacgcgtttgaatggcttgaacgttgcatcttttaaagttattttttaaggtttcttggcatttatcctagttgtccgtgtttggcaatgtgctgttaaagtaatagacttttaatctttatgtattttttgttttctctggagtacttggacagatgttatagtggtttcttttaggaaaatctgtcattaaaaaagttatagccttgcaaataaccactcacagtatttgagtcacagtttattttagtgagacgtaaagagtgctgacttcatttatttttctacctatatacctagtggaaaaggggaagactaatgttttcaaataaacaaacagaaacctaacagaa

SEQ ID NO: 29426 - DNA, 4460 bp, Homo sapiens
cctcggggagtggtccgaccgcgggcggccgccggtgagtgggcgtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggtcttttggtgggccttgtgcttcggtatggcattcatgttccgagtgatgtaaataatgtgaccctgagctgtgaagtgcagtcaagtccaactaccttactggtaaatgttagtggaaaattttatgagtatatgctgaaaggagagattagttcacatgaactcaataatgttcaagataatgaaatgcttagaaaggttacttttgatccagaagtatttttcaacatattacttcctcctatcatattttatgcaggttatagcctgaaaaggagacatttttttcgaaatcttgggtctatcctagcatacgcttttcttggaacagcaatttcttgtttcgttattgggtcaataatgtatggctgtgtaacgctgatgaaggtaacgggacaacttgcaggagatttttactttacagattgcctactgtttggtgccattgtatcagcaactgatccagtgactgttcttgctatattccacgagcttcaagttgatgttgaactctatgcacttctttttggtgaaagtgtcctcaatgatgctgttgccatagtgctgtcctcctcaatagtggcataccagccagctggagacaacagtcacacctttgatgtcacagcgatgttcaagtctattgggatcttccttggaatcttcagtggatcttttgcaatgggtgctgctactggagtggtgacagctttagtgacaaagttcaccaaattacgggagttccagttgttggagacaggcctgttcttcttgatgtcctggagtaccttcctcttggctgaagcatggggcttcacaggtgtagttgcagtattgttttgtggcatcacacaagcacattatacgtataataatttgtccacggagtctcagcatagaactaaacagttgtttgagcttctcaatttcttggcagagaatttcatcttctcctacatggggctgacactgttcaccttccagaaccatgtctttaacccaacatttgtagtaggagcatttgttgctattttcttgggaagagctgccaatatttaccccttgtccctcttacttaatttgggtagaagaagtaagattggatcaaattttcaacacatgatgatgtttgctggccttcgtggtgcaatggcatttgccttggccattcgagatactgccacttatgcacggcaaatgatgttcagcaccacgcttctgattgtgttttttaccgtgtgggtatttggtggtggcaccactgcaatgctgtcatgcttgcatatcagggttggtgttgattcagaccaagaacacttgggtgttcctgaaaatgaaaggagaactaccaaagcagagagtgcttggcttttccggatgtggtacaactttgatcataactatctgaagcctctgctgacccacagcgggcctccgctgacaacaacactccctgcctgctgtggacccatcgccaggtgcctcaccagcccccaggcttacgaaaaccaggaacagttgaaagatgatgattctgatcttattctcaatgatggtgacatcagtttgacatatggagattctactgtgaacactgaaccggccacatccagcgccccaaggagatttatgggaaacagttctgaagatgccttggatcgggagcttgcatttggggaccatgaactggtcattcgaggaacacgcctggttcttccaatggatgattctgaacccccgctaaatttgttagataatacgagacatggtccagcctaagcttactaatactcacttagtgatttgtaaaatttgcacatgtgattgtgaagaaatttgtactacctaaaagtcccagtgcatgtctctgaatgtgtaagctatataaatgctatttatatggcatagaaagaatataaatatcctgtacacggcagattgtgaacaaactatattcctttaagttttcctggttgcactctgtagactggatctgttttaggaagttactttcacagtgatgttgtgtgttctgttagttttatgtctcagttaaagtgtaaaaagtgacggattttctctttcttaaacttacctgacacttaaccagagtaccagttctcgtgatgtgaattaatttttttgtgtgctaggggagggagagtgaggagggagtgttatttccttgggaacctagggaggagaggttcctttgttgggaaacttttgttgatagctgctgcctttgtcctgatcgttttctttcccttttctctggtggcctgttgtggtgcaacgagctgatggcatttgatcttgccccattcaggttggggagtgaagtgtgaggacccttttcccccgcttgctgtgaaagcacagattcattgactacagtacactgttgttcagaaaagaaggctgcaaatgacttctgagactttatgtcttttcttccagaccaagaccgtagaaggagtcacatctagccggcttagccaaagtacaggtgtatatagttcagggcacttgatttagatttggaggggctggggtgggcagagagcaagaggcgagtaaagagaatggtggtttcagagatctctcttcccaaatgtgtaaatattctataccagataagtttaaataagaaatttaattgctgcttaatttttgattatgtactttatctgtatagcaggctttgtcgtcagaagtttttatatcgatttaaattgctgctctttagcagccaaacaggagcaaaatgtaaaatttttgaacttactgtgtctaatcatcatttgttagtctgtagttaatgtcaacagttaatttatgaacccacgatcgttccacactgcaccaaagtcagtcataagagaaatcgaatattctggagcactgattgcagcagggtggctcctttgtgtgcagcaggtgtagtagtcttcattttcatggtacgttttaatattaattacctaagctgccatgcatttttttttttacagttctcaaggaagagcacagaacaatttctcatttcatatttggagtatgaaagtagattctattttgtaatgctgataatacctaaagatgcattgaatgcttggaagaatgctttttgatgttgattttgacctgttcatgattcagaagaaaaacaaacttttttggattttttttccctcaggtctgagtagcattgccttaaatcttatccagttagaacattgatttatttacatgatgttcagattttccagtgaaaaatacccttctgaacaaaacatgtacttactctccgaaaggcatctatctgtgctattgcaaacactccttgagattttaggggaattctaatgttgtaccctttcgtggcagctttgactgttggcatagccatttgttatgtagtggtagcgactttcctgctatgcaggaatccctcccatgacgtgtatgttttacatgatgtgtgcctcttcacgcagtaaatagtttcttgttaatgtatgtttgaggagtttgaacgtcagtgtcacttacccacaaagttattcaagttgtaaaaggttatacaataatttaacaactaccttttttattctgtcgggttactgacctcactttatgtaaatacttcgcatgacaaattcagtaactcgtctatttcagcatgcataagacttttcactagggaaactgataaagcttgagtcaactaaatctgccttcatactttatcaaggggaaccaagcctgctgtgcttacatcagcatctggaagactttcctctcctctaatctgtgtacacatctccaagcaaggaagaaaaaacaaactctgctcagacgcctatgaaacacctgaatgaactttgatgaagtacagtctgagttaccatcatgcacaagtagaactgctcttggacttgttttcctgttgtttgtggaacctacgcgtttgaatggcttgaacgttgcatcttttaaagttattttttaaggtttcttggcatttatcctagttgtccgtgtttggcaatgtgctgttaaagtaatagacttttaatctttatgtattttttgttttctctggagtacttggacagatgttatagtggtttcttttaggaaaatctgtcattaaaaaagttatagccttgcaaataaccactcacagta

SEQ ID NO: 29427 - DNA, 3838 bp, Homo sapiens
gaggaggcgcggggggccccgggaccatggagcctggtgacgcggcgcgccctggctcgggtcgggctaccggggcgccgccgccgcggctgctgctgctgccgctgctgctgggttgggggctgcgagtcgcggccgcggcctcggcctcctcctctggggcggcggcggaggacagcagcgccatggaggagctcgctactgagaaggaggcggaggagagccaccggcaagacagcgtgagcctgctcaccttcatcctgctgctcacgctcaccatcctcaccatctggctcttcaagcaccgccgggtgcgctttctgcacgagaccgggctggccatgatctatgggctcatcgttggggtgatcctgaggtatggtacccctgctaccagtggccgtgacaaatcactcagctgcactcaggaagacagggccttcagtaccttattagtgaatgtcagcggaaagttcttcgaatacactctgaaaggagaaatcagtcctggcaagatcaacagcgtagagcagaatgatatgctacggaaggtaacattcgatccagaagtatttttcaacattcttctgcctccaattatttttcatgctggatacagcttaaagaagagacactttttcagaaatcttggatctatactggcctatgccttcttggggactgctgtttcatgcttcattattggaaatctcatgtatggtgtggtgaagctcatgaagattatgggacagctctcagataaattttactacacagattgtctcttttttggagcaatcatctctgccactgacccagtgactgtgctggcgatatttaatgaattgcatgcagacgtggatctttacgcacttctttttggagagagcgtcctaaatgatgctgttgccattgtactgtcctcgtctattgttgcctaccagccagcgggactgaacactcacgcctttgatgctgctgccttttttaagtcagttggcatttttctaggtatatttagtggctcttttaccatgggagctgtgactggtgttaatgccaacgtgactaagtttaccaaactgcactgcttccccctgctggagacggcgctgttcttcctcatgtcctggagcacgtttctcttggcagaagcctgcggatttacaggtgttgtagctgtccttttctgtggaatcacacaagctcattacacctacaacaatctgtcggtggaatcaagaagtcgaaccaagcagctctttgaggtgttacatttcctggcagagaacttcatcttctcctacatgggcctggcactgtttaccttccagaagcacgttttcagccccattttcatcatcggagcttttgttgccatcttcctgggcagagccgcgcacatctacccgctctccttcttcctcaacttgggcagaaggcataagattggctggaattttcaacacatgatgatgttttcaggcctcaggggagcaatggcatttgcgttggccatccgtgacacggcatcctatgctcgccagatgatgttcacgaccacccttctcattgtgttcttcactgtctggatcattggaggaggcacgacacccatgttgtcatggcttaacatcagagttggcgtcgaggagccctccgaagaggaccagaatgaacaccactggcagtacttcagagttggtgttgaccccgatcaagacccaccacccaacaacgacagctttcaagtcttacaaggggacggcccagattctgccagaggaaaccggacaaaacaggagagcgcatggatattcaggctgtggtacagctttgatcacaattacctgaagcccatcctcacacacagtggtcccccactaaccaccacgctccccgcctggtgtggcttactagctcgatgtctgaccagtccccaggtgtacgataaccaagagccactgagagaggaagactctgatttcatcctgaccgaaggcgacctgacattgacctacggggacagcacagtgactgcaaatggctcctcaagttcgcacaccgcctccacgagtctggagggcagccggagaacgaagagcagctcggaggaagtgctggagcgagacctgggaatgggagaccagaaggtttcgagccggggcacccgcctagtgtttcccctggaagataatgcttgactttccccccaagccctggcgcgatggggtaggctcccgatggggtgaggacagctgcaagccctagtgttgttggaggtggggcagtgactagattgaactaactcttctattttattggggtctgaagctattgtaacacttaaaatttaactcacaatgcagatggtgaggcaaaagtgtctctaaattcagacaaacgtagacctattcccacttttttcacatagtagtgcgctgtttcagagttaaacaaacaaaaaaaaatagcatgctttaatggtctcctaattcattcacctgcagtatctgaacaaggcgaggcaggtgctgggtggggggattcctcccatgagaggctgcatctcagtacacagcagtgcaagtcaagctgaccatagaattatcaagttaaagagaaggaaggcaattgagatcggaactccaaggattatgggaaacttggtgttaaatgggacagaaaacatgaaaaagcaatttggaggctctggcaacgaagtctgcttgactgcaacctcatatcaggattcctgactttatgctgcctgtgttttttctagactgaagatttgaaaatacatccacgaacatttcaacatggaacgaagaattatagttccttctctggctatatccataaagaagtagttatgaaatgtttaaaaccaaaggcaaatagtgttatactcttattttttgattaatctgaggaaaggaggtatttagaaactgatgatggtatcactgcaaaaagcattcaactttttttttttgttgagatggtgtttcactctgtcacccaggctggagtgcagtggcgtggtcttggctcactgcaacctctgcctcacgggttcaagtgattctcctgcctcagcctcctgattagctgggattacaggtgcccaccaccatgcccagctaattttttgtatttttggtagagatggggtttcaccatgttgcccaggctggtgtcaaactcctgacctcgtgatccacctcccttggcctcccaaagtgctgggattacaggtgtgagccactgcacctggccagcattcaacttttgagggctaccatatgagctgacagcctagggaaataatcactaggactgaagtatctactctgggtttagaaataacaccaaattttgtaggatgctattatctgggaaagggaaggcagcaagaaacctacaaggcaccaggctagaattcagagggaaagaaatctcaatgcaaaaaaattactgcaaagaaatacaagatagtagtctcaagactaggtagaattccaaactttgagccgacgaatgcatgagatttcagtggccacctgaggaatcagagggcaaacaatggaacattaagtattttcagcccactagaaagctctgtcttctataagcttaagagtccgagtgtctttacaccactgagtgccatgcagagaagggtcattttccttgtatctggggaggctgctgcaccagcttaacatgtgggtgtgatttgaaagttaggttttcagtttggattctttctggatgagctgttctgtctgcccacacctgtagtgctgaaatacagaaagacctctcgggaaaa

SEQ ID NO: 29428 - DNA, 6094 bp, Homo sapiens
gccccgcggctccgaactcggtggtcctggaagctccgcaggatgggggagaagatggcggaagaggagaggttccccaatacaactcatgagggtttcaatgtcaccctccacaccaccctggttgtcacgacgaaactggtgctcccgacccctggcaagcccatcctccccgtgcagacaggggagcaggcccagcaagaggagcagtccagcggcatgaccattttcttcagcctccttgtcctagctatctgcatcatattggtgcatttactgatccgatacagattacatttcttgccagagagtgttgctgttgtttctttaggtattctcatgggagcagttataaaaattatagagtttaaaaaactggcgaattggaaggaagaagaaatgtttcgtccaaacatgtttttcctcctcctgcttccccctattatctttgagtctggatattcattacacaagggtaacttctttcaaaatattggttccatcaccctgtttgctgtttttgggacggcaatctccgcttttgtagtaggtggaggaatttattttctgggtcaggctgatgtaatctctaaactcaacatgacagacagttttgcgtttggctccctaatatctgctgtcgatccagtggccactattgccattttcaatgcacttcatgtggaccccgtgctcaacatgctggtctttggagaaagtattctcaacgatgcagtctccattgttctgaccaacacagctgaaggtttaacaagaaaaaatatgtcagatgtcagtgggtggcaaacatttttacaagcccttgactacttcctcaaaatgttctttggctctgcagcgctcggcactctcactggcttaatttctgcattagtgctgaagcatattgacttgaggaaaacgccttccttggagtttggcatgatgatcatttttgcttatctgccttatgggcttgcagaaggaatctcactctcaggcatcatggccatccttttctcaggcatcgtgatgtcccactacacgcaccataacctctccccagtcacccagatcctcatgcagcagaccctccgcaccgtggccttcttatgtgaaacatgtgtgtttgcatttcttggcctgtccatttttagttttcctcacaagtttgaaatttcctttgtcatctggtgcatagtgcttgtactatttggcagagcggtaaacattttccctctttcctacctcctgaatttcttccgggatcataaaatcacaccgaagatgatgttcatcatgtggtttagtggcctgcggggagccatcccctatgccctgagcctacacctggacctggagcccatggagaagcggcagctcatcggcaccaccaccatcgtcatcgtgctcttcaccatcctgctgctgggcggcagcaccatgcccctcattcgcctcatggacatcgaggacgccaaggcacaccgcaggaacaagaaggacgtcaacctcagcaagactgagaagatgggcaacactgtggagtcggagcacctgtcggagctcacggaggaggagtacgaggcccactacatcaggcggcaggaccttaagggcttcgtgtggctggacgccaagtacctgaaccccttcttcactcggaggctgacgcaggaggacctgcaccacgggcgcatccagatgaaaactctcaccaacaagtggtacgaggaggtacgccagggcccctccggctccgaggacgacgagcaggagctgctctgacgccaggtgccaaggcttcaggcaggcaggcccaggatgggcgtttgctgcgcacagacactcagcaggggcctcgcagagatgcgtgcatccagcagccccttcaagacataagagggcggggcgaggtactggctgcagagtcgccttagtccagaacctgacaggcctctggagccaggcgacttcttgggaaactgtcatctcccgactcctccctgagccagcctccgctcagtgtggctcctcagcccacagaggggagggagcatggggccaggtgccagtcatctgtgaagctagggcgcctacccccccacccggaggacccctgcggccccctgcctagaggagcaccatctacagttgtgccattccccagccactgccttcatgctgcccccgccggactggcagagccaggggtcagccacctgcctttgagtcatcaagatgcctctgcagccacaattctgacctaagtggcagggcccagaaatcctgaaaacctcccgctgccttttgtgatacttcctgtgctccctcagagagaaacggagtgaccttttgtcctttacctgattggcacttcgcagtctatctccctgggtagcagacggctgctgcccttctctgggcatgttctgaatgtttacactggtaccttctggtatcttctttagagccccctgcaagctgcaactctaggcttttatcttgcggggtcagagcgccctctagagggaaaagctagaggcacagggtttctgccggcccacaactgctgtcttgatttgcattttacagcaaagtgctgagagcctctagtcgcctcctgccatctgatctccctccccaccattcccgtactcagttgttcttttgtctaatcggaggccactgtgctgaggccctgcagtgtctgctcactgctgccatcttcgctgctagtcagggttccatcctctttcccctctcccagttccctaccacgttggatcccattcgtcacccatgctagggtccccaaagcactggggcaggggccagagcagcagcacccagtgctccctcctctactctgacctggggccccagcatcctggagcacacgctccacgcacacacaccccagccctgtcccaggggcctggccccctcagccatctcagggtgaggagctgccagtcatgtccagatggaatgactcccatcctctcctcatctcccctttgacgagcctcaaactgctcagctcatcaaagagccattgccaacttccgtatgtggttctgggtcccagggagccttggaacctggcaccctggggtggtttaattcatcattaagaagcattcctgcttctcaagggacacagtggcctgcatgggccagcatggaccctgggctgatcatgtgcattcctgcttctctggggacacagtgggcccacatgggccagcatggaccctgggctagagcaagcacatctccatctcttccacctcaggcagtgtggctccagatgtcaggagggactgacctcaggaccttccaggttcctctgtgccaggaatgagaggccaggcccgatcctaccacctcgccttgaccctgaagtcagagcaggccagccaagcaggaagcacactgtttactttttgcatgaaaagtaaatgtgtacttgatagagctaaaatatgatcttttttaatttctcaaccccataatttgagccattgccttgcttaattttggtttccaccatttccttttagtggagaagagaggaagtcagagggtagggacctttgcctgcccctgggcgagtgcgggcagggatctgagaccagattgttctcgcacccctgccagaactcactctcccctgaagtttagggtcccatctcccagatgtaagttgttttgcaaactcagtttgccaggatttctttctttcctaatcttaaattcacagataaagcaatgaaaagagtcagatcccatttccgtctgccccctcgtcaccaggtgtgatagccccagccaggtcacacctggcctcacactttgagctgagacttgaaaacgatgctgtggcggaagagcatgtggggcttggtggaggggccccaggatttgttgggggcaaagggggtggcgggaccgttcccaggaggtaccagcacctgcctcgatctcctctgagcctcttctgccccctgtcggccaggtgaggtcagcagcctgggagagtgcccccaagagatgagggcaccccgtgttccttggcaatcttggctcaccttggtaacaaaaggccatagaagtctgtttttctgggtcagttttttttgcctgagaataacaaattgctgctgtctacctttagcacacccaataattctatttggggcagtgaatgcatagaagatataaaaatacgcagcttaactatatcttcctgcgtgtgtatttattttcttctgggtctaggccatggtacaggagaactgtggcgtgtaggaggaatacttcaggatgagtgaaggctggagccagggagcgctggaggaaaccagccctttagccagcagcccctccaccacaggcactgctgtgtggaacgagttcttggaatgaatcccatgctttctgcagcctgtagttgttatgacccctcggaacaaccaccccgtggcttgtgtggggtctcgcagggaaaagggctggcttctaggtccccgagataagtgtgcagggggatgggccagggccaggctaagggtggctcagttccatcatctggaggtcagacacactgtccagaggcagaactgaagccctctcggcccctaccctaagccagccacccctcttcacagtgggtgagctgggctgggctggctggcatgaggccaaggggtaggcctgagcgccagagtcgcccaggttagcccacaggattcctttgtgtgccatggaatgctgaaagatgggtgactggggacccttcttaaaacctttggcaaaggtgccatcggcagggcttggcctcatgaagtctcaggtccgtgttcccgcagggcgcacatgcttggagagtcctcagcagggtagccgaggccaggccacttctgctgaggatggggcaggctggggtgtgggtgtggcctggggtggctcagggctggaactgctgcctgattcctgtgtggggagaagctcagtggccgtttgctgccactgacaaggatttcacatgcagaagagaaaaggcccccctccaccccccgcattccctgccgagtgagagccagtgtttgctgcccttgctgggggcgggtaggaaaccctgagcttcctgatgcggagtcatgaagcagagtcctcgggaaggcatctccacagccccgggtcctctgtctaacgccctccatttcacgccctccatctcacagtcaagataaaggcctcgagaataaagagccagcccccttccatttagtctcctgccgtttcccaaacagttgtccaacagttagacattgaggggcttcactgttaccaggcatgtaacagaaggaggaagactaacacacaccccctgccccatcccatccccctctcccgagctattttcttgctgtggcctctggtgcccttgagttggtctccccggctgctctgcgggggcttcactggcttcggagtgagcgcgaagtgctggtgagcagtgggcctgtgattggatgggaagatgtgcatccgtggtcaaaagtcagctgccagccctgcggaaccagagcctcaggctgggatggggaggcctccctgcttccacctgcatggtgggcatggcctggcttacaccaaaggctttgacggtttctccaagtaaggatctgcaaatcttgaatcgtcctcaaaatgacgaagcttgaattgtcctcaagatggatgtgaatcttacattccttttcatcatttcctttgtaaaaatgacgagtgctgggtttttgttttaagaagcattatgaaggccagacttactcatttttctcccccaagtgagctgcaagaggcccctgttaggcccctgtttcctgagcagtgatgtgctgctcttcttggtggggctttgggctgggaggggaaggcgggtcagagatgggggacctgtggctgccatgcaggagcccctgcgtcatctcgttggactctttaagggagtcaggaatagatgtatgaacagtcgtgtcactggatgcctatttagaaataaagtgtatgctgctgaattgga

SEQ ID NO: 29429 - DNA, 6303 bp, Homo sapiens
ccgaaagccccgggagagactaagaagcaatcctcccacgcgctttctcccaccctcgggccactgagacggagggacagagggccgccctcgcgcggccgaggccccgcctcccgctcgcccgcccgcgcctccagcggaagccggaagcaaaagcgggtcctgctagccccgcggctccgaactcggtggtcctggaagctccgcaggatgggggagaagatggcggaagaggagaggttccccaatacaactcatgagggtttcaatgtcaccctccacaccaccctggttgtcacgacgaaactggtgctcccgacccctggcaagcccatcctccccgtgcagacaggggagcaggcccagcaagaggagcagtccagcggcatgaccattttcttcagcctccttgtcctagctatctgcatcatattggtgcatttactgatccgatacagattacatttcttgccagagagtgttgctgttgtttctttaggtattctcatgggagcagttataaaaattatagagtttaaaaaactggcgaattggaaggaagaagaaatgtttcgtccaaacatgtttttcctcctcctgcttccccctattatctttgagtctggatattcattacacaagggtaacttctttcaaaatattggttccatcaccctgtttgctgtttttgggacggcaatctccgcttttgtagtaggtggaggaatttattttctgggtcagggttttttttttgtgtgtgtctgtgtgtttgtgtgttttattttacaggctgatgtaatctctaaactcaacatgacagacagttttgcgtttggctccctaatatctgctgtcgatccagtggccactattgccattttcaatgcacttcatgtggaccccgtgctcaacatgctggtctttggagaaagtattctcaacgatgcagtctccattgttctgaccaacacagctgaaggtttaacaagaaaaaatatgtcagatgtcagtgggtggcaaacatttttacaagcccttgactacttcctcaaaatgttctttggctctgcagcgctcggcactctcactggcttaatttctgcattagtgctgaagcatattgacttgaggaaaacgccttccttggagtttggcatgatgatcatttttgcttatctgccttatgggcttgcagaaggaatctcactctcaggcatcatggccatccttttctcaggcatcgtgatgtcccactacacgcaccataacctctccccagtcacccagatcctcatgcagcagaccctccgcaccgtggccttcttatgtgaaacatgtgtgtttgcatttcttggcctgtccatttttagttttcctcacaagtttgaaatttcctttgtcatctggtgcatagtgcttgtactatttggcagagcggtaaacattttccctctttcctacctcctgaatttcttccgggatcataaaatcacaccgaagatgatgttcatcatgtggtttagtggcctgcggggagccatcccctatgccctgagcctacacctggacctggagcccatggagaagcggcagctcatcggcaccaccaccatcgtcatcgtgctcttcaccatcctgctgctgggcggcagcaccatgcccctcattcgcctcatggacatcgaggacgccaaggcacaccgcaggaacaagaaggacgtcaacctcagcaagactgagaagatgggcaacactgtggagtcggagcacctgtcggagctcacggaggaggagtacgaggcccactacatcaggcggcaggaccttaagggcttcgtgtggctggacgccaagtacctgaaccccttcttcactcggaggctgacgcaggaggacctgcaccacgggcgcatccagatgaaaactctcaccaacaagtggtacgaggaggtacgccagggcccctccggctccgaggacgacgagcaggagctgctctgacgccaggtgccaaggcttcaggcaggcaggcccaggatgggcgtttgctgcgcacagacactcagcaggggcctcgcagagatgcgtgcatccagcagccccttcaagacataagagggcggggcgaggtactggctgcagagtcgccttagtccagaacctgacaggcctctggagccaggcgacttcttgggaaactgtcatctcccgactcctccctgagccagcctccgctcagtgtggctcctcagcccacagaggggagggagcatggggccaggtgccagtcatctgtgaagctagggcgcctacccccccacccggaggacccctgcggccccctgcctagaggagcaccatctacagttgtgccattccccagccactgccttcatgctgcccccgccggactggcagagccaggggtcagccacctgcctttgagtcatcaagatgcctctgcagccacaattctgacctaagtggcagggcccagaaatcctgaaaacctcccgctgccttttgtgatacttcctgtgctccctcagagagaaacggagtgaccttttgtcctttacctgattggcacttcgcagtctatctccctgggtagcagacggctgctgcccttctctgggcatgttctgaatgtttacactggtaccttctggtatcttctttagagccccctgcaagctgcaactctaggcttttatcttgcggggtcagagcgccctctagagggaaaagctagaggcacagggtttctgccggcccacaactgctgtcttgatttgcattttacagcaaagtgctgagagcctctagtcgcctcctgccatctgatctccctccccaccattcccgtactcagttgttcttttgtctaatcggaggccactgtgctgaggccctgcagtgtctgctcactgctgccatcttcgctgctagtcagggttccatcctctttcccctctcccagttccctaccacgttggatcccattcgtcacccatgctagggtccccaaagcactggggcaggggccagagcagcagcacccagtgctccctcctctactctgacctggggccccagcatcctggagcacacgctccacgcacacacaccccagccctgtcccaggggcctggccccctcagccatctcagggtgaggagctgccagtcatgtccagatggaatgactcccatcctctcctcatctcccctttgacgagcctcaaactgctcagctcatcaaagagccattgccaacttccgtatgtggttctgggtcccagggagccttggaacctggcaccctggggtggtttaattcatcattaagaagcattcctgcttctcaagggacacagtggcctgcatgggccagcatggaccctgggctgatcatgtgcattcctgcttctctggggacacagtgggcccacatgggccagcatggaccctgggctagagcaagcacatctccatctcttccacctcaggcagtgtggctccagatgtcaggagggactgacctcaggaccttccaggttcctctgtgccaggaatgagaggccaggcccgatcctaccacctcgccttgaccctgaagtcagagcaggccagccaagcaggaagcacactgtttactttttgcatgaaaagtaaatgtgtacttgatagagctaaaatatgatcttttttaatttctcaaccccataatttgagccattgccttgcttaattttggtttccaccatttccttttagtggagaagagaggaagtcagagggtagggacctttgcctgcccctgggcgagtgcgggcagggatctgagaccagattgttctcgcacccctgccagaactcactctcccctgaagtttagggtcccatctcccagatgtaagttgttttgcaaactcagtttgccaggatttctttctttcctaatcttaaattcacagataaagcaatgaaaagagtcagatcccatttccgtctgccccctcgtcaccaggtgtgatagccccagccaggtcacacctggcctcacactttgagctgagacttgaaaacgatgctgtggcggaagagcatgtggggcttggtggaggggccccaggatttgttgggggcaaagggggtggcgggaccgttcccaggaggtaccagcacctgcctcgatctcctctgagcctcttctgccccctgtcggccaggtgaggtcagcagcctgggagagtgcccccaagagatgagggcaccccgtgttccttggcaatcttggctcaccttggtaacaaaaggccatagaagtctgtttttctgggtcagttttttttgcctgagaataacaaattgctgctgtctacctttagcacacccaataattctatttggggcagtgaatgcatagaagatataaaaatacgcagcttaactatatcttcctgcgtgtgtatttattttcttctgggtctaggccatggtacaggagaactgtggcgtgtaggaggaatacttcaggatgagtgaaggctggagccagggagcgctggaggaaaccagccctttagccagcagcccctccaccacaggcactgctgtgtggaacgagttcttggaatgaatcccatgctttctgcagcctgtagttgttatgacccctcggaacaaccaccccgtggcttgtgtggggtctcgcagggaaaagggctggcttctaggtccccgagataagtgtgcagggggatgggccagggccaggctaagggtggctcagttccatcatctggaggtcagacacactgtccagaggcagaactgaagccctctcggcccctaccctaagccagccacccctcttcacagtgggtgagctgggctgggctggctggcatgaggccaaggggtaggcctgagcgccagagtcgcccaggttagcccacaggattcctttgtgtgccatggaatgctgaaagatgggtgactggggacccttcttaaaacctttggcaaaggtgccatcggcagggcttggcctcatgaagtctcaggtccgtgttcccgcagggcgcacatgcttggagagtcctcagcagggtagccgaggccaggccacttctgctgaggatggggcaggctggggtgtgggtgtggcctggggtggctcagggctggaactgctgcctgattcctgtgtggggagaagctcagtggccgtttgctgccactgacaaggatttcacatgcagaagagaaaaggcccccctccaccccccgcattccctgccgagtgagagccagtgtttgctgcccttgctgggggcgggtaggaaaccctgagcttcctgatgcggagtcatgaagcagagtcctcgggaaggcatctccacagccccgggtcctctgtctaacgccctccatttcacgccctccatctcacagtcaagataaaggcctcgagaataaagagccagcccccttccatttagtctcctgccgtttcccaaacagttgtccaacagttagacattgaggggcttcactgttaccaggcatgtaacagaaggaggaagactaacacacaccccctgccccatcccatccccctctcccgagctattttcttgctgtggcctctggtgcccttgagttggtctccccggctgctctgcgggggcttcactggcttcggagtgagcgcgaagtgctggtgagcagtgggcctgtgattggatgggaagatgtgcatccgtggtcaaaagtcagctgccagccctgcggaaccagagcctcaggctgggatggggaggcctccctgcttccacctgcatggtgggcatggcctggcttacaccaaaggctttgacggtttctccaagtaaggatctgcaaatcttgaatcgtcctcaaaatgacgaagcttgaattgtcctcaagatggatgtgaatcttacattccttttcatcatttcctttgtaaaaatgacgagtgctgggtttttgttttaagaagcattatgaaggccagacttactcatttttctcccccaagtgagctgcaagaggcccctgttaggcccctgtttcctgagcagtgatgtgctgctcttcttggtggggctttgggctgggaggggaaggcgggtcagagatgggggacctgtggctgccatgcaggagcccctgcgtcatctcgttggactctttaagggagtcaggaatagatgtatgaacagtcgtgtcactggatgcctatttagaaataaagtgtatgctgctg

SEQ ID NO: 29430 - DNA, 2309 bp, Homo sapiens
aagctccgcaggatgggggagaagatggcggaagaggagaggttccccaatacaactcatgagggtttcaatgtcaccctccacaccaccctggttgtcacgacgaaactggtgctcccgacccctggcaagcccatcctccccgtgcagacaggggagcaggcccagcaagaggagcagtccagcggcatgaccattttcttcagcctccttgtcctagctatctgcatcatattggtgcatttactgatccgatacagattacatttcttgccagagagtgttgctgttgtttctttaggtattctcatgggagcagttataaaaattatagagtttaaaaaactggcgaattggaagggtaacttctttcaaaatattggttccatcaccctgtttgctgtttttgggacggcaatctccgcttttgtagtaggtggaggaatttattttctgggtcagttttgcgtttggctccctaatatctgctgtcgatccagtggccactattgccattttcaatgcacttcatgtggaccccgtgctcaacatgctggtctttggagaaagtattctcaacgatgcagtctccattgttctgaccaacacagctgaaggtttaacaagaaaaaatatgtcagatgtcagtgggtggcaaacatttttacaagcccttgactacttcctcaaaatgttctttggctctgcagcgctcggcactctcactggcttaatttctgcattagtgctgaagcatattgacttgaggaaaacgccttccttggagtttggcatgatgatcatttttgcttatctgccttatgggcttgcagaaggaatctcactctcaggcatcatggccatccttttctcaggcatcgtgatgtcccactacacgcaccataacctctccccagtcacccagatcctcatgcagcagaccctccgcaccgtggccttcttatgtgaaacatgtgtgtttgcatttcttggcctgtccatttttagttttcctcacaagtttgaaatttcctttgtcatctggtgcatagtgcttgtactatttggcagagcggtaaacattttccctctttcctacctcctgaatttcttccgggatcataaaatcacaccgaagatgatgttcatcatgtggtttagtggcctgcggggagccatcccctatgccctgagcctacacctggacctggagcccatggagaagcggcagctcatcggcaccaccaccatcgtcatcgtgctcttcaccatcctgctgctgggcggcagcaccatgcccctcattcgcctcatggacatcgaggacgccaaggcacaccgcaggaacaagaaggacgtcaacctcagcaagactgagaagatgggcaacactgtggagtcggagcacctgtcggagctcacggaggaggagtacgaggcccactacatcaggcggcaggaccttaagggcttcgtgtggctggacgccaagtacctgaaccccttcttcactcggaggctgacgcaggaggacctgcaccacgggcgcatccagatgaaaactctcaccaacaagtggtacgaggaggtacgccagggcccctccggctccgaggacgacgagcaggagctgctctgacgccaggtgccaaggcttcaggcaggcaggcccaggatgggcgtttgctgcgcacagacactcagcaggggcctcgcagagatgcgtgcatccagcagccccttcaagacataagagggcggggcgaggtactggctgcagagtcgccttagtccagaacctgacaggcctctggagccaggcgacttcttgggaaactgtcatctcccgactcctccctgagccagcctccgctcagtgtggctcctcagcccacagaggggagggagcatggggccaggtgccagtcatctgtgaagctagggcgcctacccccccacccggaggacccctgcggccccctgcctagaggagcaccatctacagttgtgccattccccagccactgccttcatgctgcccccgccggactggcagagccaggggtcagccacctgcctttgagtcatcaagatgcctctgcagccacaattctgacctaagtggcagggcccagaaatcctgaaaacctcccgctgccttttgtgatacttcctgtgctccctcagagagaaacggagtgaccttttgtcctttacctgattggcacttcgcagtctatctccctgggtagcagacggctgctgcccttctctgggcatgttctgaatgtttacactggtaccttctg

SEQ ID NO: 29431 - DNA, 2163 bp, Homo sapiens
gaagctccgcaggatgggggagaagatggcggaagaggagaggttccccaatacaactcatgagggtttcaatgtcaccctccacaccaccctggttgtcacgacgaaactggtgctcccgacccctggcaagcccatcctccccgtgcagacaggggagcaggcccagcaagaggagcagtccagcggcatgaccattttcttcagcctccttgtcctagctatctgcatcatattggtgcatttactgatccgatacagattacatttcttgccagagagtgttgctgttgtttctttaggtattctcatgggagcagttataaaaattatagagtttaaaaaactggcgaattggaaggaagaagaaatgtttcgtccaaacatgtttttcctcctcctgcttccccctattatctttgagtctggatattcattacacaagggtaacttctttcaaaatattggttccatcaccctgtttgctgtttttgggacggcaatctccgcttttgtagtaggtggaggaatttattttctgggtcagttttgcgtttggctccctaatatctgctgtcgatccagtggccactattgccattttcaatgcacttcatgtggaccccgtgctcaacatgctggtctttggagaaagtattctcaacgatgcagtctccattgttctgaccaattgtcatttacgtgctgaagcatattgacttgaggaaaacgccttccttggagtttggcatgatgatcatttttgcttatctgccttatgggcttgcagaaggaatctcactctcaggcatcatggccatccttttctcaggcatcgtgatgtcccactacacgcaccataacctctccccagtcacccagatcctcatgcagcagaccctccgcaccgtggccttcttatgtgaaacatgtgtgtttgcatttcttggcctgtccatttttagttttcctcacaagtttgaaatttcctttgtcatctggtgcatagtgcttgtactatttggcagagcggtaaacattttccctctttcctacctcctgaatttcttccgggatcataaaatcacaccgaagatgatgttcatcatgtggtttagtggcctgcggggagccatcccctatgccctgagcctacacctggacctggagcccatggagaagcggcagctcatcggcaccaccaccatcgtcatcgtgctcttcaccatcctgctgctgggcggcagcaccatgcccctcattcgcctcatggacatcgaggacgccaaggcacaccgcaggaacaagaaggacgtcaacctcagcaagactgagaagatgggcaacactgtggagtcggagcacctgtcggagctcacggaggaggagtacgaggcccactacatcaggcggcaggaccttaagggcttcgtgtggctggacgccaagtacctgaaccccttcttcactcggaggctgacgcaggaggacctgcaccacgggcgcatccagatgaaaactctcaccaacaagtggtacgaggaggtacgccagggcccctccggctccgaggacgacgagcaggagctgctctgacgccaggtgccaaggcttcaggcaggcaggcccaggatgggcgtttgctgcgcacagacactcagcaggggcctcgcagagatgcgtgcatccagcagccccttcaagacataagagggcggggcgaggtactggctgcagagtcgccttagtccagaacctgacaggcctctggagccaggcgacttcttgggaaactgtcatctcccgactcctccctgagccagcctccgctcagtgtggctcctcagcccacagaggggagggagcatggggccaggtgccagtcatctgtgaagctagggcgcctacccccccacccggaggacccctgcggccccctgcctagaggagcaccatctacagttgtgccattccccagccactgccttcatgctgcccccgccggactggcagagccaggggtcagccacctgcctttgagtcatcaagatgcctctgcagccacaattctgacctaagtggcagggcccagaaatcctgaaaacctcccgctgccttttgtgatacttcctgtgctccctcagagagaaacggagtgacctt

SEQ ID NO: 29432 - DNA, 3627 bp, Homo sapiens
aaaagagacagggctgctttaagagagaaacaggaagttgtaactagaagccatctgaatactaagccagggcagaatgcttgtgaagtagcaactaaagtggcagtgtttcttctgaaattctcaggcagtcagactgtcttaggcaaatcttgataaaatagcctttatccaggtttttatctaaggaatcccaagaagactggggaatggagagacagtcaagggttatgtcagaaaaggatgagtatcagtttcaacatcagggagcggtggagctgcttgtcttcaattttttgctcatccttaccattttgacaatctggttatttaaaaatcatcgattccgcttcttgcatgaaactggaggagcaatggtgtatggccttataatgggactaattttacgatatgctacagcaccaactgatattgaaagtggaactgtctatgactgtgtaaaactaactttcagtccatcaactctgctggttaatatcactgaccaagtttatgaatataaatacaaaagagaaataagtcagcacaacatcaatcctcatcaaggaaatgctatacttgaaaagatgacatttgatccagaaatcttcttcaatgttttactgccaccaattatatttcatgcaggatatagtctaaagaagagacacttttttcaaaacttaggatctattttaacgtatgccttcttgggaactgccatctcctgcatcgtcatagggttaattatgtatggttttgtgaaggctatgatacatgctggccagctgaaaaatggagactttcatttcactgactgtttattttttggttcactgatgtctgctacagatccagtgacagtgctggccattttccatgaactgcacgtcgaccctgacctgtacacactcttgtttggagagagtgtgttgaatgatgcagtggccatagtccttacatattctatatccatttacagtcccaaggagaatccaaatgcatttgatgccgcagcattcttccagtctgtggggaatttcctgggaatcttcgctggctcatttgcaatggggtctgcgtatgccatcatcacagcactgttgaccaaatttaccaagctgtgtgagttcccgatgctggaaaccggcctgtttttcctgctttcttggagtgccttcctgtctgccgaggctgccggcctaacagggatagttgctgttctcttctgtggagtcacacaagcacattatacctacaacaatctgtcttcggattccaaaataagaactaaacagttgtttgaatttatgaactttttggcggagaacgtcatcttctgttacatgggcctggcactgttcacgttccagaatcatatctttaatgctctttttatacttggagcctttctagcaatttttgttgccagagcctgcaacatatatcccctctccttcctcctgaatctaggccgaaaacagaagatcccctggaactttcagcacatgatgatgttttcaggtttgcgaggagcgatcgcatttgccttagctattcggaacacagaatctcagcccaaacaaatgatgtttaccactacgctgctcctcgtgttcttcactgtctgggtatttggaggaggaacaacccccatgttgacttggcttcagatcagagttggcgtggacctggatgaaaatctgaaggaggacccctcctcacaacaccaggaagcaaataacttggataaaaacatgacgaaagcagagagtgctcggctcttcagaatgtggtatagctttgaccacaagtatctgaaaccaattttaacccactctggtcctccgctgactacaacattacctgaatggtgtggtccgatttccaggctgcttaccagtcctcaagcctatggggaacagctaaaagaggatgatgtggaatgcattgtaaaccaggatgaactagccataaattaccaggagcaagcctcctcaccctgcagtcctcctgcaaggctaggtctggaccagaaagcttcaccccagacgccaggcaaggaaaacatttatgagggagacctcggcctgggaggctatgaactcaagcttgagcaaactttgggtcaatcccagttgaattaattggcatgaagagtacagatgtaatcacaagtaatgcaagactcactgaggaatacaagccaagctgatgaggcagtacaggggagaggctggaaaacatattaagagcataaattggagagaatcaaagccttgtcacatggatcctctggtgcctgaagaaatgagattttattatccctctctattatgcaaatgaatttagttttttgacagcagccattctgattactggattggctggggtggggatggaggtatcaggagtctagctgctggaggatgggacagctgtgctgggtcttcagggcatttctgctgcgaatgcggctctccaggcccttcacttctattctggattttattccctccattaaggagagtttaaaaataaaagaaagcttctgagagtaaacattttgctcctaagctgaagggaatgcccagctatttagtaagtgataagtttcttattttgaggacttgactcccatttgctctcagtgaccccagggcagagcccagagaagtgttccgtacccactgctgatggtttcccagagcccacactgagttgaagaacctattgttcttcttggcatccttcttatgctacttctcccatcgctcaaaggggttgcctatggctgggtgtgccctgccctaaatgcagcaccactttcaagcttagtaggaccattccaagaaaaccaggtttcttctccccataccacgttgtgcctgaagaacaagccttcccgtccttgcctgcatgtgagtcacttcttggctgtgcagcaggtccccccctccccgcgatatgctggagggtaggattctgcagcctgtgttgctctctacctggcagcagactgtgcaggagccccaacctgtcctccaattccagcattcacagctgatgagcagtgcaggagcagggcgagaggaacagagccaatgatgtgtgggttacactgaggagccaaggacagggcctcaggtctcccccttacaaggcgtggctcatggcctgcattccagagaccaacatgatagcttttaattcagctgcatgacctgtgccttttaagccataaagatacctcaagcctagcacctcttgaaatccagatgttcatattagactcgaaaaaataggctccaggcctaggtgcccaggctatgatgagtctgcttttgaaggaggtagggaatgacatcttccttggacccaaagcttaaaagtaatgtatgctttgctgaccactgtttgttaggccttaaacaacattcactgtggtggtatcaggcacactgctatgtgcatcaattatttttttgctttccaaacagaatctctggggcacaagttttacactcaagctaagtataactttgtcatttcaggtaaatatgacaagtggtggagcatgaagttttctaatttgacttaatcctaataaatttttgttacaaagta

SEQ ID NO: 29433 - DNA, 978 bp, Homo sapiens
cttagactccagagtagctgggagcagatgacatttgatccagaaatcttcttcaatgttttactgccaccaattatatttcatgcaggatatagtctaaagaagagacacttttttcaaaacttaggatctattttaacgtatgccttcttgggaactgccatctcctgcatcgtcatagggttaattatgtatggttttgtgaaggctatgatacatgctggccagctgaaaaatggagactttcatttcactgactgtttattttttggttcactgatgtctgctacagatccagtgacagtgctggccattttccatgaactgcacgtcgaccctgacctgtacacactcttgtttggagagagtgtgttgaatgatgcagtggccatagtccttacatattctatatccatttacagtcccaaggagaatccaaatgcatttgatgccgcagcattcttccagtctgtggggaatttcctgggaatcttcgctggctcatttgcaatggggtctgcgtatgccatcatcacagcactgttgaccaaatttaccaagctgtgtgagttcccgatgctggaaaccggcctgtttttcctgctttcttggagtgccttcctgtctgccgaggctgccggcctaacagggatagttgctgttctcttctgtggagtcacacaagcacattatacctacaacaatctgtcttcggattccaaaataagaactaaacagttgtttgaatttatgaactttttggcggagaacgtcatcttctgttacatgggcctggcactgttcacgttccagaatcatatctttaatgctctttttatacttggagcctttgtatctatattcctagccagagcccacactgagttgaagaacctattgttcttcttggcatccttcttatgctacttctcccatcgctcaaaggggttgcctatggctgggtgtgccctgccctaa

SEQ ID NO: 29434 - DNA, 4172 bp, Homo sapiens
aagagatgatgggcctgaagctaaccggtgcagactaggggcgagtttggagcaagtaactgtcagtgaggttgcagttggtctgggctgtttggctgtgagcgaaatagctgccccccacttctcacttgcacaccacgggatactcctcctgaggctccggatgattcagatggactgtgaaaaacaacaagatggatgatcatatggagattgcttctaacataaatctgcataaaaatttttctgaaacatggctggaatatttaaggagttttttttcagtactgaggacctccctgaagtcattctaacattgtctttgatcagctccattggagcatttttgaaccggcacttggaagactttccaattcctgtccctgtgatattatttttacttggatgcagttttgaagtattaagctttacatcttcacaggtccaaagatacgcaaacgccatacaatggatgagtccagacttattttttcgtatatttacaccagtagttttctttactactgcatttgacatggatacgtacatgcttcaaaagttattttggcagatacttttaatttcaattcccggctttttggttaattatatcttagttctttggcatctggcatctgtaaatcaattacttttgaagcctacccaatggttattattttcagctatccttgtgagttcagatcccatgctaaccgcagctgctataagagaccttgggctttctagaagcctcatcagtttaattaatggagaaagtctgatgacctctgttatatcattaattacatttactagtattatggattttgaccaaagactacaaagtaaaagaaaccataccttagctgaagagatcgtgggtggaatttgttcatatattatagcaagtttcttgtttggaattctaagttcaaaactgattcaattttggatgtcaactgtttttggtgatgatgtcaatcatataagtctcatcttttcaattctgtatctcatcttttatatttgtgagttagttggaatgtcaggaatatttactctggccattgtgggacttcttttaaattctacaagttttaaagcagcaattgaagaaacacttcttcttgaattctggacttttctatcacgtattgcttttctcatggtgtttactttctttggacttctaattcctgcacatacatatttgtatatagaatttgttgatatatactattcattaaatatctacttaacattgattgttttaagatttctgacccttcttttaataagccctgttttgtctcgagttggtcatgagttcagttggcgctggatattcataatggtctgtagtgaaatgaaggggatgcctaatataaacatggcccttctgcttgcctactctgatctttattttggatctgacaaagaaaaatctcaaatattatttcatggagtgttagtatgcctaataacccttgttgtcaatagatttattttgccagtggcagttactatactaggtcttcgtgatgccacatcaacaaaatataaatcggtttgttgcacatttcaacactttcaagagctaaccaagtctgcagcctctgcccttaaatttgacaaagatcttgctaatgctgattggaacatgattgagaaagcaattacacttgaaaacccatacatgttgaacgaagaagaaacaacagaacatcagaaggtgaaatgtccacactgtaacaaggaaatagatgagatctttaacactgaagcaatggagctggccaacaggcgtctcttgtcagcacaaatagcaagctaccagagacaatacaggaatgagattctgtcccagagtgctgtccaggtgttggttggtgcagcagaaagttttggtgagaagaagggaaaatgtatgagtcttgatacaataaagaattattctgaaagccaaaaaacagttacctttgctagaaaactactacttaattgggtgtataataccagaaaggaaaaagagggcccatcaaaatacttcttttttcgtatatgccatacaatagtatttactgaggaatttgaacatgttggataccttgtgatattaatgaatatatttccctttataatctcttggatatcccagttaaatgtaatctaccacagcgaattaaaacacactaactactgttttcttacactttatattctagaggcactacttaagatagcagcaatgaggaaggactttttttcacatgcctggaacatattcgagttagcaattacattaattggcatcttacatgtaatacttattgaaatagacaccattaagtatatttttaatgagactgaagtaatagtctttataaaagttgttcaattttttcgtatactacgcattttcaagctcatagcaccaaagttgctgcaaataatagataaaagaatgagtcatcagaagaccttttggtatggaatactaaaaggctatgtccaaggcgaagcagacataatgaccataattgatcagattacaagttctaaacagattaaacagatgttattaaagcaagtgataaggaatatggaacatgctataaaagagctaggctacttagagtatgatcacccagaaattgctgtcactgtgaaaacaaaggaagaaattaatgttatgctcaatatggctacagaaattcttaaggcttttggcttaaaaggaattattagtaaaactgaaggtgctggaattaataagttaatcatggccaaaaagaaagaggtgcttgattctcaatctattatcaggcctcttactgttgaagaagttctatatcatattccgtggctagataaaaacaaagattatataaacttcattcaggaaaaagccaaagttgtaacatttgattgtggaaatgatatatttgaagaaggtgatgagcccaaaggaatctatatcattatttcaggcatggtaaagcttgaaaaatcaaagccaggtttagggattgatcaaatggtggagtcaaaggagaaagattttccgataattgacacagactatatgctcagtggagaaataataggagagataaactgcttaactaatgaacctatgaaatattctgccacctgcaaaactgtagtggagacatgttttattcccaaaactcacttgtatgatgcttttgagcaatgctctcctctcattaaacaaaaaatgtggctaaaacttggactcgctattacagccagaaaaatcagagaacacttatcttatgaggattggaactacaatatgcaactaaagctctctaatatttatgtagtagatataccaatgagtaccaaaactgatatttatgatgaaaatctaatctatgttatcctcatacatggagctgtagaagattgtctgttacgaaaaacttatagagcacctttcttaattcctataacatgccatcagatacaaagtattgaagatttcacaaaagtagtgattattcaaactccgattaacatgaaaacattcagaaggaatattagaaagtttgttcctaaacataaaagttatcttacaccaggattaataggttcagttggaacattggaagaaggcattcaagaagaaagaaatgttaaggaggatggagcacacagtgccgccactgccaggagtccccagccttgctccctgctggggacaaagttcaactgtaaggagtcccctagaataaacctaaggaaagtcaggaaagagtaagactgttaagaagaccgaagcatgtattaatgctgtggctatgagaggcctcctgctgcagaaacacacttccctacatcaagaaggagtaacttcaggttggatcctgtgtggatgatcttggtgctaagcagaaaagaaatttggaccttgaaaccagcagttcaacatatatactttttgcaaaatttccttgatttaaaatatttgttattttaaatatacaaaacattttagaaaatcttagagtaaattttagtcttaaagccagaaaataagtttatagccatctagatattttgcatattgctcttacagcaataatggtttggttcactttatgaaaaataaaatgtattaaaatatagtttaaatgctgttcttg

SEQ ID NO: 29435 - DNA, 3979 bp, Homo sapiens
agactaggggcgagtttggagcaagtaactgtcagtgaggttgcagttggtctgggctgtttggctgtgagcgaaatagctgccccccacttctcacttgcacaccacgggatactcctcctgaggctccggatgattcagatggactgtgaaaaacaacaagatggatgatcatatggagattgcttctaacataaatctgcataaaaatttttctgaaacatggctggaatatttaaggagttttttttcagtactgaggacctccctgaagtcattctaacattgtctttgatcagctccattggagcatttttgaaccggcacttggaagactttccaattcctgtccctgtgatattatttttacttggatgcagttttgaagtattaagctttacatcttcacaggtccaaagatacgcaaacgccatacaatggatgagtccagacttattttttcgtatatttacaccagtagttttctttactactgcatttgacatggatacgtacatgcttcaaaagttattttggcagatacttttaatttcaattcccggctttttggttaattatatcttagttctttggcatctggcatctgtaaatcaattacttttgaagcctacccaatggttattattttcagctatccttgtgagttcagatcccatgctaaccgcagctgctataagagaccttgggctttctagaagcctcatcagtttaattaatggagaaagtctgatgacctctgttatatcattaattacatttactagtattatggattttgaccaaagactacaaagtaaaagaaaccataccttagctgaagagatcgtgggtggaatttgttcatatattatagcaagtttcttgtttggaattctaagttcaaaactgattcaattttggatgtcaactgtttttggtgatgatgtcaatcatataagtctcatcttttcaattctgtatctcatcttttatatttgtgagttagttggaatgtcaggaatatttactctggccattgtgggacttcttttaaattctacaagttttaaagcagcaattgaagaaacacttcttcttgaatttctgacccttcttttaataagccctgttttgtctcgagttggtcatgagttcagttggcgctggatattcataatggtctgtagtgaaatgaaggggatgcctaatataaacatggcccttctgcttgcctactctgatctttattttggatctgacaaagaaaaatctcaaatattatttcatggagtgttagtatgcctaataacccttgttgtcaatagatttattttgccagtggcagttactatactaggtcttcgtgatgccacatcaacaaaatataaatcggtttgttgcacatttcaacactttcaagagctaaccaagtctgcagcctctgcccttaaatttgacaaagatcttgctaatgctgattggaacatgattgagaaagcaattacacttgaaaacccatacatgttgaacgaagaagaaacaacagaacatcagaaggtgaaatgtccacactgtaacaaggaaatagatgagatctttaacactgaagcaatggagctggccaacaggcgtctcttgtcagcacaaatagcaagctaccagagacaatacaggaatgagattctgtcccagagtgctgtccaggtgttggttggtgcagcagaaagttttggtgagaagaagggaaaatgtatgagtcttgatacaataaagaattattctgaaagccaaaaaacagttacctttgctagaaaactactacttaattgggtgtataataccagaaaggaaaaagagggcccatcaaaatacttcttttttcgtatatgccatacaatagtatttactgaggaatttgaacatgttggataccttgtgatattaatgaatatatttccctttataatctcttggatatcccagttaaatgtaatctaccacagcgaattaaaacacactaactactgttttcttacactttatattctagaggcactacttaagatagcagcaatgaggaaggactttttttcacatgcctggaacatattcgagttagcaattacattaattggcatcttacatgtaatacttattgaaatagacaccattaagtatatttttaatgagactgaagtaatagtctttataaaagttgttcaattttttcgtatactacgcattttcaagctcatagcaccaaagttgctgcaaataatagataaaagaatgagtcatcagaagaccttttggtatggaatactaaaaggctatgtccaaggcgaagcagacataatgaccataattgatcagattacaagttctaaacagattaaacagatgttattaaagcaagtgataaggaatatggaacatgctataaaagagctaggctacttagagtatgatcacccagaaattgctgtcactgtgaaaacaaaggaagaaattaatgttatgctcaatatggctacagaaattcttaaggcttttggcttaaaaggaattattagtaaaactgaaggtgctggaattaataagttaatcatggccaaaaagaaagaggtgcttgattctcaatctattatcaggcctcttactgttgaagaagttctatatcatattccgtggctagataaaaacaaagattatataaacttcattcaggaaaaagccaaagttgtaacatttgattgtggaaatgatatatttgaagaaggtgatgagcccaaaggaatctatatcattatttcaggcatggtaaagcttgaaaaatcaaagccaggtttagggattgatcaaatggtggagtcaaaggagaaagattttccgataattgacacagactatatgctcagtggagaaataataggagagataaactgcttaactaatgaacctatgaaatattctgccacctgcaaaactgtagtggagacatgttttattcccaaaactcacttgtatgatgcttttgagcaatgctctcctctcattaaacaaaaaatgtggctaaaacttggactcgctattacagccagaaaaatcagagaacacttatcttatgaggattggaactacaatatgcaactaaagctctctaatatttatgtagtagatataccaatgagtaccaaaactgatatttatgatgaaaatctaatctatgttatcctcatacatggagctgtagaagattgtctgttacgaaaaacttatagagcacctttcttaattcctataacatgccatcagatacaaagtattgaagatttcacaaaagtagtgattattcaaactccgattaacatgaaaacattcagaaggaatattagaaagtttgttcctaaacataaaagttatcttacaccaggattaataggttcagttggaacattggaagaaggcattcaagaagaaagaaatgttaaggaggatggagcacacagtgccgccactgccaggagtccccagccttgctccctgctggggacaaagttcaactgtaaggagtcccctagaataaacctaaggaaagtcaggaaagagtaagactgttaagaagaccgaagcatgtattaatgctgtggctatgagaggcctcctgctgcagaaacacacttccctacatcaagaaggagtaacttcaggttggatcctgtgtggatgatcttggtgctaagcagaaaagaaatttggaccttgaaaccagcagttcaacatatatactttttgcaaaatttccttgatttaaaatatttgttattttaaatatacaaaacattttagaaaatcttagagtaaattttagtcttaaagccagaaaataagtttatagccatctagatattttgcatattgctcttacagcaataatggtttggttcactttatgaaaaataaaatgtattaaaatata

SEQ ID NO: 29436 - DNA, 2705 bp, Homo sapiens
ggggcgagcgggaaagcggcagcggcggcggcggcggcggcggcgggggaaggatgcaggggaagaagccgggcggttcgtcgggcggcggccggagcggcgagctgcagggggacgaggcgcagaggaacaagaaaaagaaaaagaaggtgtcctgcttttccaacatcaagatcttcctggtgtccgagtgcgccctgatgctggcgcagggcacggtgggcgcctacctggtgagcgtcctgaccaccctggagcgtaggttcaacctgcagagcgctgacgtgggtgtgatcgctagcagcttcgagatcgggaacctggcgctcatcctcttcgtgagctacttcggggcacgcgggcaccggccgcgcctgatcggctgcggcggcatcgtcatggcgctgggcgcgctgctgtcggcgctgcccgagttcctgacccaccagtacaagtacgaggcgggcgagatccgctggggcgccgagggccgcgacgtctgcgcagccaacggctcgggcggcgacgaggggcccgaccccgacctcatctgccgcaaccggacggctaccaacatgatgtacttgctgctcattggggcccaggtgctcctgggcatcggtgctacccctgtgcagcccctgggcgtctcctacatcgacgaccacgtgcggaggaaggactcctcgctctatataggaatcctgttcacgatgctggtatttggaccagcctgcgggtttatcctgggctctttctgtaccaaaatctacgtggatgcggtcttcattgacacaagtaacctggacatcactccggacgacccccgctggatcggagcctggtggggtggctttctgctctgcggtgccttactcttcttctcttccctcttgatgtttgggtttccacagtccctgcccccgcactcagagcccgccatggaaagcgagcaggccatgctctccgaaagagaatacgagagacccaagcccagcaacggggtcctgaggcaccccctggagccagacagcagtgcctcctgtttccagcagctgagagtgatcccgaaggtcaccaagcacctgctctcaaaccctgtgttcacctgcatcatcctggccgcctgcatggagattgcagtggtggctggcttcgctgcctttttggggaagtacctggagcagcagtttaacctcaccacctcttctgccaaccagctgcttgggatgactgcgatcccgtgtgcttgtctgggtatcttcctgggaggtcttttggtgaagaagctcagcctgtctgccctgggggccattcggatggccatgctcgtcaacctggtgtccactgcttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagaggccttcctcactttcctctgtgtgatgtgtatctgcagcctgatcggtgccatggcacagacaccctcagtcatcatcctcatcaggacagtcagccctgaactcaagtcttacgctttgggagttctttttctcctccttcgtttgttgggcttcatccctccacccctcatcttcggggctggcatcgactccacctgcctgttctggagcacgttctgtggggagcaaggcgcctgcgtcctctacgacaatgtggtctaccgatacctgtatgtcagcatcgccatcgcgctcaaatccttcgccttcatcctgtacaccaccacgtggcagtgcctgaggaaaaactataaacgctacatcaaaaaccacgagggcgggctgagcaccagcacagagtaccaagacattgagactgagaaaacctgccccgaatcacattcaccttcagaagactcctttgtgagaagctgagggcctggccctcttcctcttcctggagagaacagcccaccaccacccacagacctcgcgggcctcacttagcgcgctcctccctgtccgagaacccgagggtccccatgtggattatccagccagtgtgtggtcctttgaggccccaagcgcaggcctgtgatgaggaccaaagaggtgacttatggtcaggagtactccaaacagctctcagagtaggcatctttcctgggtctctaaagagtcatgctgacctggtgtgcaaattcccttccacccatccctctacctcctctggggatggcttgccgacatgctttagaaactcccctcttgggaatgctcctctgactgagggctccaacagctttaatgaaatcagccgagagggtaaaaaccaacctgttgcatagaatggaggggggaaaaagcacatactcaatagatttttgagtgtggtactctgtatttttgcagcgtttattttccaaatgagcagtttagaaatatgtgatgtaaagtacatactgtacgtttgctgaaaattatattaaaagcactattttaattctt

SEQ ID NO: 29437 - DNA, 2229 bp, Homo sapiens
gacttgttgcagttgctgtaggattctaaatccaggtgattgtttcaaactgagcatcaacaacaaaaacatttgtatgatatctatatttcaatcatggaccaaaatcaacatttgaataaaacagcagaggcacaaccttcagagaataagaaaacaagatactgcaatggattgaagatgttcttggcagctctgtcactcagctttattgctaagacactaggtgcaattattatgaaaagttccatcattcatatagaacggagatttgagatatcctcttctcttgttggttttattgacggaagctttgaaattggaaatttgcttgtgattgtatttgtgagttactttggatccaaactacatagaccaaagttaattggaatcggttgtttcattatgggaattggaggtgttttgactgctttgccacatttcttcatgggatattacaggtattctaaagaaactaatatcaattcatcagaaaattcaacatcgaccttatccacttgtttaattaatcaaattttatcactcaatagagcatcacctgagatagtgggaaaaggttgtttaaaggaatctgggtcatacatgtggatatatgtgttcatgggtaatatgcttcgtggaataggggagactcccatagtaccattggggctttcttacattgatgatttcgctaaagaaggacattcttctttgtatttaggtatattgaatgcaatagcaatgattggtccaatcattggctttaccctgggatctctgttttctaaaatgtacgtggatattggatatgtagatctaagcactatcaggataactcctactgattctcgatgggttggagcttggtggcttaatttccttgtgtctggactattctccattatttcttccataccattctttttcttgccccaaactccaaataaaccacaaaaagaaagaaaagcttcactgtctttgcatgtgctggaaacaaatgatgaaaaggatcaaacagctaatttgaccaatcaaggaaaaaatattaccaaaaatgtgactggttttttccagtcttttaaaagcatccttactaatcccctgtatgttatgtttgtgcttttgacgttgttacaagtaagcagctatattggtgcttttacttatgtcttcaaatacgtagagcaacagtatggtcagccttcatctaaggctaacatcttattgggagtcataaccatacctatttttgcaagtggaatgtttttaggaggatatatcattaaaaaattcaaactgaacaccgttggaattgccaaattctcatgttttactgctgtgatgtcattgtccttttacctattatattttttcatactctgtgaaaacaaatcagttgccggactaaccatgacctatgatggaaataatccagtgacatctcatagagatgtaccactttcttattgcaactcagactgcaattgtgatgaaagtcaatgggaaccagtctgtggaaacaatggaataacttacatctcaccctgtctagcaggttgcaaatcttcaagtggcaataaaaagcctatagtgttttacaactgcagttgtttggaagtaactggtctccagaacagaaattactcagcccatttgggtgaatgcccaagagatgatgcttgtacaaggaaattttacttttttgttgcaatacaagtcttgaatttatttttctctgcacttggaggcacctcacatgtcatgctgattgttaaaattgttcaacctgaattgaaatcacttgcactgggtttccactcaatggttatacgagcactaggaggaattctagctccaatatattttggggctctgattgatacaacgtgtataaagtggtccaccaacaactgtggcacacgtgggtcatgtaggacatataattccacatcattttcaagggtctacttgggcttgtcttcaatgttaagagtctcatcacttgttttatatattatattaatttatgccatgaagaaaaaatatcaagagaaagatatcaatgcatcagaaaatggaagtgtcatggatgaagcaaacttagaatccttaaataaaaataaacattttgtcccttctgctggggcagatagtgaaacacattgttaaggggagaaaaaaagccacttctgcttctgtgtttccaaacagcattgcattgattca

SEQ ID NO: 29438 - DNA, 2712 bp, Homo sapiens
gagactttaacatcagaaaaaggatggacttgttgcagttgctgtagcattcaaagtcaaggtgatcatttcaaaccaagcatcagcaacaattaaaaatattcacttggtatctgtagtttaataatggaccaacatcaacatttgaataaaacagcagagtcagcatcttcagagaaaaagaaaacaagacgctgcaatggattcaagatgttcttggcagccctgtcattcagctatattgctaaagcactaggtggaatcattatgaaaatttccatcactcaaatagaaaggagatttgacatatcctcttctcttgctggtttaattgatggaagctttgaaattggaaatttgcttgtgattgtatttgtaagttactttggatctaaactacacagaccgaagttaattggaattggttgtctccttatgggaactggaagtattttgacatctttaccacatttcttcatgggatattataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaatttcactatcattgcatgtgctgaaaacaaatgatgatagaaatcaaacagctaatttgaccaaccaaggaaaaaatgttaccaaaaatgtgactggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacagtgttttataactgtagttgtgtggaagtaactggtctccagaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagattgttcaacctgaattgaaagcacttgcaatgggtttccagtcaatggttataagaacactaggaggaattctagctccaatatattttggggctctgattgataaaacatgtatgaagtggtccaccaacagctgtggagcacaaggggcttgtaggatatataattccgtattttttggaagggtctacttgggcttatctatagctttaagattcccagcacttgttttatatattgttttcatttttgctatgaagaaaaaatttcaaggaaaagataccaaggcatcggacaatgaaagaaaagtaatggatgaagcaaacttagaattcttaaataatggtgaacattttgtaccttctgctggaacagatagtaaaacatgtaatttggacatgcaagacaatgctgctgccaactaacattgcattgattcattaagatgttatttttgaggtgttcctggtctttcactgacaattccaacattctttacttacagtggaccaatggataagtctatgcatctataataaactataaaaaatgggagtacccatggttaggatatagctatgcctttatggttaagattagaatatatgatccataaaaatttaaagtgagaggcatggttagtgtgtgatacaataaaaagtaattgtttggtagttgtaactgctaataaaaccagtgactagaatataagggaggtaaaaaggacaagatagattaatagcctaaataaagagaaaagcctgatgcctttaaaaaaaatgaaacactttggatgtattacttaggccaaaatctggcctggatttatgctataatatatattttcatgttaagttgtatatttttcagaaattataaatattattaatttaaaatttgaa

SEQ ID NO: 29439 - DNA, 2805 bp, Homo sapiens
gatggacttgttgcagttgctgtagcattcaaagtcaagttgtgctttgcgatgctgagtttactgttttaaatggacttcaagcatagccctgaagtgttgtcccgttgttcccacctcctagagggcctgacagaagaggtacatatgctatgtgatcatttcaaaccaagcatcagcaacaattaaaaatattcacttggtatctgtagtttaataatggaccaacatcaacatttgaataaaacagcagagtcagcatcttcagagaaaaagaaaacaagacgctgcaatggattcaagatgttcttggcagccctgtcattcagctatattgctaaagcactaggtggaatcattatgaaaatttccatcactcaaatagaaaggagatttgacatatcctcttctcttgctggtttaattgatggaagctttgaaattggaaatttgcttgtgattgtatttgtaagttactttggatctaaactacacagaccgaagttaattggaattggttgtctccttatgggaactggaagtattttgacatctttaccacatttcttcatgggatattataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaatttcactatcattgcatgtgctgaaaacaaatgatgatagaaatcaaacagctaatttgaccaaccaaggaaaaaatgttaccaaaaatgtgactggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacagtgttttataactgtagttgtgtggaagtaactggtctccagaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagattgttcaacctgaattgaaagcacttgcaatgggtttccagtcaatggttataagaacactaggaggaattctagctccaatatattttggggctctgattgataaaacatgtatgaagtggtccaccaacagctgtggagcacaaggggcttgtaggatatataattccgtattttttggaagggtctacttgggcttatctatagctttaagattcccagcacttgttttatatattgttttcatttttgctatgaagaaaaaatttcaaggaaaagataccaaggcatcggacaatgaaagaaaagtaatggatgaagcaaacttagaattcttaaataatggtgaacattttgtaccttctgctggaacagatagtaaaacatgtaatttggacatgcaagacaatgctgctgccaactaacattgcattgattcattaagatgttatttttgaggtgttcctggtctttcactgacaattccaacattctttacttacagtggaccaatggataagtctatgcatctataataaactataaaaaatgggagtacccatggttaggatatagctatgcctttatggttaagattagaatatatgatccataaaaatttaaagtgagaggcatggttagtgtgtgatacaataaaaagtaattgtttggtagttgtaactgctaataaaaccagtgactagaatataagggaggtaaaaaggacaagatagattaatagcctaaataaagagaaaagcctgatgcctttaaaaaaaatgaaacactttggatgtattacttaggccaaaatctggcctggatttatgctataatatatattttcatgttaagttgtatatttttcagaaattataaatattattaatttaaaatttgaa

SEQ ID NO: 29440 - DNA, 2247 bp, Homo sapiens
atggaccaacatcaacatttgaataaaacagcagagtcagcatcttcagagaaaaagaaaacaagacgctgcaatggattcaagatgttcttggcagccctgtcattcagctatattgctaaagcactaggtggaatcattatgaaaatttccatcactcaaatagaaaggagatttgacatatcctcttctcttgctggtttaattgatggaagctttgaaattggaaatttgcttgtgattgtatttgtaagttactttggatctaaactacacagaccgaagttaattggaattggttgtctccttatgggaactggaagtattttgacatctttaccacatttcttcatgggatattataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaatttcactatcattgcatgtgctgaaaacaaatgatgatagaaatcaaacagctaatttgaccaaccaaggaaaaaatgttaccaaaaatgtgactggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacagtgttttataactgtagttgtgtggaagtaactggtctccagaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagattgttcaacctgaattgaaagcacttgcaatgggtttccagtcaatggttataagaacactaggaggaattctagctccaatatattttggggctctgattgataaaacatgtatgaagtggtccaccaacagctgtggagcacaaggggcttgtaggatatataattccgtattttttgggattgttcaacctgaattgaaagcacttgcaatcggcttccattcaatgattatgcgatcgctaggaggtattctagttccaatatattttggggctctgattgatacaacgtgtatgaagtggtccaccaacagctgtggagcacgaggggcttgtaggatatataattccacatatttgggaagagccttcttcggcttgaaggtagccctaatatttccagtacttgttttacttactgtatttatttttgttgtaaggaaaaaatcccatggaaaggataccaaagtattagaaaatgaaagacaagtaatggatgaagcaaacttagaattcttaaacgacagtgaacattttgtaccttctgctgaagaacagtaa

SEQ ID NO: 29441 - DNA, 3365 bp, Homo sapiens
gcaaagaaatggctcaaaagcttcagctctttctgtgccctgggagctgagatgcacgtcagtggccttgccagcgtggccaattctctgctgactgccagaaaaaagaggccaggaagaaagaggaaagagaagagatcgctcaggggtgagaccatgcccttcatcttttcttttccctaatctcctctgcttgtgtccacccacactctccccacctggcaaaattgttcaaaattgctgtggagtttacctcagtttcctctttcagtctgtggtgtgtggtccatcctcttgctgagcacattgaaaggaactggctatctttgatctcttcctccagatcagagtcaaggaatgtgtttataatggacacttcatccaaagaaaatatccagttgttctgcaaaacttcagtgcaacctgttggaaggccttcttttaaaacagaatatccctcctcagaagaaaagcaaccatgctgtggtgaactaaaggtgttcttgtgtgccttgtcttttgtttactttgccaaagcattggcagaaggctatctgaagagcaccatcactcagatagagagaaggtttgatatcccttcttcactggtgggagttattgatggtagttttgaaattgggaatctcttagttataacatttgttagctactttggagccaaacttcacaggccaaaaataattggagcagggtgtgtaatcatgggagttggaacactgctcattgcaatgcctcagttcttcatggagcagtacaaatatgagagatattctccttcctccaattccactctcagcatctctccgtgtctcctagagtcaagcagtcaattaccagtttcagttatggaaaaatcaaaatccaaaataagtaacgaatgtgaagtggacactagctcttccatgtggatttatgttttcctgggcaatcttcttcgtggaataggagaaactcccattcagcctttgggcattgcctacctggatgattttgccagtgaagacaatgcagctttctatattgggtgtgtgcagacggttgcaattataggaccaatctttggtttcctgttaggctcattatgtgccaaactatatgttgacattggctttgtaaacctagatcacataaccattaccccaaaagatccccagtgggtaggagcctggtggcttggctatctaatagcaggaatcataagtcttcttgcagctgtgcctttctggtatttaccaaagagtttaccaagatcccaaagtagagaggattctaattcttcctctgagaaatccaagtttattatagatgatcacacagactaccaaacaccccagggagaaaatgcaaaaataatggaaatggcaagagattttcttccatcactgaagaatctttttggaaacccagtatacttcctatatttatgtacaagcactgttcagttcaattctctgttcggcatggtgacgtacaaaccaaagtacattgagcagcagtatggacagtcatcctccagggccaactttgtgatcgggctcatcaacattccagcagtggcccttggaatattctctggggggatagttatgaaaaaattcagaatcagtgtgtgtggagctgcaaaactctacttgggatcatctgtctttggttacctcctatttctttccctgtttgcactgggctgtgaaaattctgatgtggcaggactaactgtctcctaccaaggaaccaaacctgtctcttatcatgaacgagctctcttttcagattgcaactcaagatgcaaatgttcagagacaaaatgggaacccatgtgcggtgaaaatggaatcacatatgtatcagcttgtcttgctggttgtcaaacctccaacaggagtggaaaaaatattatattttacaactgcacttgtgtgggaattgcagcttctaaatccggaaattcctcaggcatagtgggaagatgtcagaaagacaatggatgtccccaaatgtttctgtatttccttgtaatttcagtcatcacatcctatactttatccctaggtggcatacctggatacatattacttctgaggtgcattaagccacagcttaagtcttttgccttgggtatctacacattagcaataagagttcttgcaggaatcccagctccagtgtattttggagttttgattgatacttcatgcctcaaatggggatttaaaagatgtggaagtagaggatcatgcagattatatgattcaaatgtcttcagacatatatatctgggactaactgtgatactgggcacagtgtcaattctcctaagcattgcagtacttttcattttaaagaaaaattatgtttcaaaacacagaagttttataaccaagagagaaagaacaatggtgtctacaagattccaaaaggaaaattacactacaagtgatcatctgctacaacccaactactggccaggcaaggaaactcaactttagaaacatgatgactggaagtcatgtcttctaattggttgacattttgcaaacaaataaattgtaatcaaaagagctctaaatttgtaatttctttctcctttcaaaaaatgtctactttgttttggtcctaggcattaggtaatataactgataatatactgaaacatataatggaagatgcagatgataaaactaattttgaactttttaatttatataaattattttatatcacttacttatttcactttattttgctttgtgctcattgatatatattagctgtactcctagaagaacaattgtctctattgtcacacatggttatatttaaagtaatttctgaactgtgtaatgtgtctagagtaagcaaatactgctaacaattaactcataccttgggttccttcaagtattactcctatagtattttctcccatagctgtcttcatctgtgtattttaataatgatcttaggatggagcagaacatggagaggaagatttcattttaagctcctccttttctttgaaatacaataatttatatagaaatgtgtagcagcaaattatattggggattagaattttgaattaatagctctcctactattaatttacatgtgctttttgtgtggcgctataagtgactatggttgtaaagtaataaaattgatgttaacatgcccaattattgttcttttatgaatccaatgaatttaaaactattgttaaatataatactgccccactttaatatatgtaagcaacttcctacttatacacgacgtgttcctaaaacatgtttgaaaggtgaatttctgaaagtctacaataaatgtaggtgttacaacaggaa

SEQ ID NO: 29442 - DNA, 3466 bp, Homo sapiens
gcaaagaaatggctcaaaagcttcagctctttctgtgccctgggagctgagatgcacgtcagtggccttgccagcgtggccaattctctgctgactgccagaaaaaagaggccaggaagaaagaggaaagagaagagatcgctcaggggtgagaccatgcccttcatcttttcttttccctaatctcctctgcttgtgtccacccacactctccccacctggcaaaattgttcaaaattgctgtggagtttacctcagtttcctctttcagtctgtggtgtgtggtccatcctcttgctgagcacattgaaaggaactggctatctttgatctcttcctccagatcagagtcaaggaatgtgtttataatggacacttcatccaaagaaaatatccagttgttctgcaaaacttcagtgcaacctgttggaaggccttcttttaaaacagaatatccctcctcagaagaaaagcaaccatgctgtggtgaactaaaggtgttcttgtgtgccttgtcttttgtttactttgccaaagcattggcagaaggctatctgaagagcaccatcactcagatagagagaaggtttgatatcccttcttcactggtgggagttattgatggtagttttgaaattgggaatctcttagttataacatttgttagctactttggagccaaacttcacaggccaaaaataattggagcagggtgtgtaatcatgggagttggaacactgctcattgcaatgcctcagttcttcatggagcagtacaaatatgagagatattctccttcctccaattccactctcagcatctctccgtgtctcctagagtcaagcagtcaattaccagtttcagttatggaaaaatcaaaatccaaaataagtaacgaatgtgaagtggacactagctcttccatgtggatttatgttttcctgggcaatcttcttcgtggaataggagaaactcccattcagcctttgggcattgcctacctggatgattttgccagtgaagacaatgcagctttctatattgggtgtgtgcagacggttgcaattataggaccaatctttggtttcctgttaggctcattatgtgccaaactatatgttgacattggctttgtaaacctagatcacataaccattaccccaaaagatccccagtgggtaggagcctggtggcttggctatctaatagcaggaatcataagtcttcttgcagctgtgcctttctggtatttaccaaagagtttaccaagatcccaaagtagagaggattctaattcttcctctgagaaatccaagtttattatagatgatcacacagactaccaaacaccccagggagaaaatgcaaaaataatggaaatggcaagagattttcttccatcactgaagaatctttttggaaacccagtatacttcctatatttatgtacaagcactgttcagttcaattctctgttcggcatggtgacgtacaaaccaaagtacattgagcagcagtatggacagtcatcctccagggccaactttgtgatcgggctcatcaacattccagcagtggcccttggaatattctctggggggatagttatgaaaaaattcagaatcagtgtgtgtggagctgcaaaactctacttgggatcatctgtctttggttacctcctatttctttccctgtttgcactgggctgtgaaaattctgatgtggcaggactaactgtctcctaccaaggaaccaaacctgtctcttatcatgaacgagctctcttttcagattgcaactcaagatgcaaatgttcagagacaaaatgggaacccatgtgcggtgaaaatggaatcacatatgtatcagcttgtcttgctggttgtcaaacctccaacaggagtggaaaaaatattatattttacaactgcacttgtgtgggaattgcagcttctaaatccggaaattcctcaggcatagtgggaagatgtcagaaagacaatggatgtccccaaatgtttctgtatttccttgtaatttcagtcatcacatcctatactttatccctaggtggcatacctggatacatattacttctgaggtgcattaagccacagcttaagtcttttgccttgggtatctacacattagcaataagagttcttgcaggaatcccagctccagtgtattttggagttttgattgatacttcatgcctcaaatggggatttaaaagatgtggaagtagaggatcatgcagattatatgattcaaatgtcttcaggtaccaaatcaaaagcattcccgcatctcattgctacagcatcccagatttacacaatgccactgacactaacaagttttcatgtcatttcactgcttgtaagacatatatatctgggactaactgtgatactgggcacagtgtcaattctcctaagcattgcagtacttttcattttaaagaaaaattatgtttcaaaacacagaagttttataaccaagagagaaagaacaatggtgtctacaagattccaaaaggaaaattacactacaagtgatcatctgctacaacccaactactggccaggcaaggaaactcaactttagaaacatgatgactggaagtcatgtcttctaattggttgacattttgcaaacaaataaattgtaatcaaaagagctctaaatttgtaatttctttctcctttcaaaaaatgtctactttgttttggtcctaggcattaggtaatataactgataatatactgaaacatataatggaagatgcagatgataaaactaattttgaactttttaatttatataaattattttatatcacttacttatttcactttattttgctttgtgctcattgatatatattagctgtactcctagaagaacaattgtctctattgtcacacatggttatatttaaagtaatttctgaactgtgtaatgtgtctagagtaagcaaatactgctaacaattaactcataccttgggttccttcaagtattactcctatagtattttctcccatagctgtcttcatctgtgtattttaataatgatcttaggatggagcagaacatggagaggaagatttcattttaagctcctccttttctttgaaatacaataatttatatagaaatgtgtagcagcaaattatattggggattagaattttgaattaatagctctcctactattaatttacatgtgctttttgtgtggcgctataagtgactatggttgtaaagtaataaaattgatgttaacatgcccaattattgttcttttatgaatccaatgaatttaaaactattgttaaatataatactgccccactttaatatatgtaagcaacttcctacttatacacgacgtgttcctaaaacatgtttgaaaggtgaatttctgaaagtctacaataaatgtaggtgttacaacagg

SEQ ID NO: 29443 - DNA, 2529 bp, Homo sapiens
attgcaaagaaatggctcaaaagcttcagctctttctgtgccctgggagctgagatgcacgtcagtggccttgccagcgtggccaattctctgctgactgccagaaaaaagaggccaggaagaaagaggaaagagaagagatcgctcagggtctgtggtgtgtggtccatcctcttgctgagcacattgaaaggaactggctatctttgatctcttcctccagatcagagtcaaggaatgtgtttataatggacacttcatccaaagaaaatatccagttgttctgcaaaacttcagtgcaacctgttggaaggccttcttttaaaacagaatatccctcctcagaagaaaagcaaccatgctgtggtgaactaaaggtgttcttgtgtgccttgtcttttgtttactttgccaaagcattggcagaaggctatctgaagagcaccatcactcagatagagagaaggtttgatatcccttcttcactggtgggagttattgatggtagttttgaaattgggaatctcttagttataacatttgttagctactttggagccaaacttcacaggccaaaaataattggagcagggtgtgtaatcatgggagttggaacactgctcattgcaatgcctcagttcttcatggagcagtacaaatatgagagatattctccttcctccaattccactctcagcatctctccgtgtctcctagagtcaagcagtcaattaccagtttcagttatggaaaaatcaaaatccaaaataagtaacgggtgtgtgcagacggttgcaattataggaccaatctttggtttcctgttaggctcattatgtgccaaactatatgttgacattggctttgtaaacctagatcacataaccattaccccaaaagatccccagtgggtaggagcctggtggcttggctatctaatagcaggaatcataagtcttcttgcagctgtgcctttctggtatttaccaaagagtttaccaagatcccaaagtagagaggattctaattcttcctctgagaaatccaagtttattatagatgatcacacagactaccaaacaccccagggagaaaatgcaaaaataatggaaatggcaagagattttcttccatcactgaagaatctttttggaaacccagtatacttcctatatttatgtacaagcactgttcagttcaattctctgttcggcatggtgacgtacaaaccaaagtacattgagcagcagtatggacagtcatcctccagggccaactttgtgatcgggctcatcaacattccagcagtggcccttggaatattctctggggggatagttatgaaaaaattcagaatcagtgtgtgtggagctgcaaaactctacttgggatcatctgtctttggttacctcctatttctttccctgtttgcactgggctgtgaaaattctgatgtggcaggactaactgtctcctaccaaggaaccaaacctgtctcttatcatgaacgagctctcttttcagattgcaactcaagatgcaaatgttcagagacaaaatgggaacccatgtgcggtgaaaatggaatcacatatgtatcagcttgtcttgctggttgtcaaacctccaacaggagtggaaaaaatattatattttacaactgcacttgtgtgggaattgcagcttctaaatccggaaattcctcaggcatagtgggaagatgtcagaaagacaatggatgtccccaaatgtttctgtatttccttgtaatttcagtcatcacatcctatactttatccctaggtggcatacctggatacatattacttctgaggtgcattaagccacagcttaagtcttttgccttgggtatctacacattagcaataagagttcttgcaggaatcccagctccagtgtattttggagttttgattgatacttcatgcctcaaatggggatttaaaagatgtggaagtagaggatcatgcagattatatgattcaaatgtcttcagacatatatatctgggactaactgtgatactgggcacagtgtcaattctcctaagcattgcagtacttttcattttaaagaaaaattatgtttcaaaacacagaagttttataaccaagagagaaagaacaatggtgtctacaagattccaaaaggaaaattacactacaagtgatcatctgctacaacccaactactggccaggcaaggaaactcaactttagaaacatgatgactggaagtcatgtcttctaattggttgacattttgcaaacaaataaattgtaatcaaaagagctctaaatttgtaatttctttctcctttcaaaaaatgtctactttgttttggtcctaggcattaggtaatataactgataatatactgaaacatataatggaagatgcagatgataaaactaattttgaactttttaatttatataaattattttatatcacttacttatttcactttattttgctttgtgctcattgatatatattagctgtact

SEQ ID NO: 29444 - DNA, 2868 bp, Homo sapiens
aagagatcgctcaggggtgagaccatgcccttcatcttttcttttccctaatctcctctgcttgtgtccacccacactctccccacctggcaaaattgttcaaaattgctgtggagtttacctcagtttcctctttcagtctgtggtgtgtggtccatcctcttgctgagcacattgaaaggaactggctatctttgatctcttcctccagggaatctcttagttataacatttgttagctactttggagccaaacttcacaggccaaaaataattggagcagggtgtgtaatcatgggagttggaacactgctcattgcaatgcctcagttcttcatggagcagtacaaatatgagagatattctccttcctccaattccactctcagcatctctccgtgtctcctagagtcaagcagtcaattaccagtttcagttatggaaaaatcaaaatccaaaataagtaacgaatgtgaagtggacactagctcttccatgtggatttatgttttcctgggcaatcttcttcgtggaataggagaaactcccattcagcctttgggcattgcctacctggatgattttgccagtgaagacaatgcagctttctatattgggtgtgtgcagacggttgcaattataggaccaatctttggtttcctgttaggctcattatgtgccaaactatatgttgacattggctttgtaaacctagatcacataaccattaccccaaaagatccccagtgggtaggagcctggtggcttggctatctaatagcaggaatcataagtcttcttgcagctgtgcctttctggtatttaccaaagagtttaccaagatcccaaagtagagaggattctaattcttcctctgagaaatccaagtttattatagatgatcacacagactaccaaacaccccagggagaaaatgcaaaaataatggaaatggcaagagattttcttccatcactgaagaatctttttggaaacccagtatacttcctatatttatgtacaagcactgttcagttcaattctctgttcggcatggtgacgtacaaaccaaagtacattgagcagcagtatggacagtcatcctccagggccaactttgtgatcgggctcatcaacattccagcagtggcccttggaatattctctggggggatagttatgaaaaaattcagaatcagtgtgtgtggagctgcaaaactctacttgggatcatctgtctttggttacctcctatttctttccctgtttgcactgggctgtgaaaattctgatgtggcaggactaactgtctcctaccaaggaaccaaacctgtctcttatcatgaacgagctctcttttcagattgcaactcaagatgcaaatgttcagagacaaaatgggaacccatgtgcggtgaaaatggaatcacatatgtatcagcttgtcttgctggttgtcaaacctccaacaggagtggaaaaaatattatattttacaactgcacttgtgtgggaattgcagcttctaaatccggaaattcctcaggcatagtgggaagatgtcagaaagacaatggatgtccccaaatgtttctgtatttccttgtaatttcagtcatcacatcctatactttatccctaggtggcatacctggatacatattacttctgaggtgcattaagccacagcttaagtcttttgccttgggtatctacacattagcaataagagttcttgcaggaatcccagctccagtgtattttggagttttgattgatacttcatgcctcaaatggggatttaaaagatgtggaagtagaggatcatgcagattatatgattcaaatgtcttcaggtaccaaatcaaaagcattcccgcatctcattgctacagcatcccagatttacacaatgccactgacactaacaagttttcatgtcatttcactgcttgtaagacatatatatctgggactaactgtgatactgggcacagtgtcaattctcctaagcattgcagtacttttcattttaaagaaaaattatgtttcaaaacacagaagttttataaccaagagagaaagaacaatggtgtctacaagattccaaaaggaaaattacactacaagtgatcatctgctacaacccaactactggccaggcaaggaaactcaactttagaaacatgatgactggaagtcatgtcttctaattggttgacattttgcaaacaaataaattgtaatcaaaagagctctaaatttgtaatttctttctcctttcaaaaaatgtctactttgttttggtcctaggcattaggtaatataactgataatatactgaaacatataatggaagatgcagatgataaaactaattttgaactttttaatttatataaattattttatatcacttacttatttcactttattttgctttgtgctcattgatatatattagctgtactcctagaagaacaattgtctctattgtcacacatggttatatttaaagtaatttctgaactgtgtaatgtgtctagagtaagcaaatactgctaacaattaactcataccttgggttccttcaagtattactcctatagtattttctcccatagctgtcttcatctgtgtattttaataatgatcttaggatggagcagaacatggagaggaagatttcattttaagctcctccttttctttgaaatacaataatttatatagaaatgtgtagcagcaaattatattggggattagaattttgaattaatagctctcctactattaatttacatgtgctttttgtgtggcgctataagtgactatggttgtaaagtaataaaattgatgttaacatgc

SEQ ID NO: 29445 - DNA, 3453 bp, Homo sapiens
gttgtgttttctgggaatcagcaagtaagatcacaagtggtcttttcttttattcactctctcccataaagaaagctttatcacgtgtggccttaaacttgcagcaaattgcaaagaaatggctcaaaagcttcagctctttctgtgccctgggagctgagatgcacgtcagtggccttgccagcgtggccaattctctgctgactgccagaaaaaagaggccaggaagaaagaggaaagagaagagatcgctcagggtctgtggtgtgtggtccatcctcttgctgagcacattgaaaggaactggctatctttgatctcttcctccagatcagagtcaaggaatgtgtttataatggacacttcatccaaagaaaatatccagttgttctgcaaaacttcagtgcaacctgttggaaggccttcttttaaaacagaatatccctcctcagaagaaaagcaaccatgctgtggtgaactaaaggtgttcttgtgtgccttgtcttttgtttactttgccaaagcattggcagaaggctatctgaagagcaccatcactcagatagagagaaggtttgatatcccttcttcactggtgggagttattgatggtagttttgaaattgggaatctcttagttataacatttgttagctactttggagccaaacttcacaggccaaaaataattggagcagggtgtgtaatcatgggagttggaacactgctcattgcaatgcctcagttcttcatggagcagtacaaatatgagagatattctccttcctccaattccactctcagcatctctccgtgtctcctagagtcaagcagtcaattaccagtttcagttatggaaaaatcaaaatccaaaataagtaacgaatgtgaagtggacactagctcttccatgtggatttatgttttcctgggcaatcttcttcgtggaataggagaaactcccattcagcctttgggcattgcctacctggatgattttgccagtgaagacaatgcagctttctatattgggtgtgtgcagacggttgcaattataggaccaatctttggtttcctgttaggctcattatgtgccaaactatatgttgacattggctttgtaaacctagatcacataaccattaccccaaaagatccccagtgggtaggagcctggtggcttggctatctaatagcaggaatcataagtcttcttgcagctgtgcctttctggtatttaccaaagagtttaccaagatcccaaagtagagaggattctaattcttcctctgagaaatccaagtttattatagatgatcacacagactaccaaacaccccagggagaaaatgcaaaaataatggaaatggcaagagattttcttccatcactgaagaatctttttggaaacccagtatacttcctatatttatgtacaagcactgttcagttcaattctctgttcggcatggtgacgtacaaaccaaagtacattgagcagcagtatggacagtcatcctccagggccaactttgtgatcgggctcatcaacattccagcagtggcccttggaatattctctggggggatagttatgaaaaaattcagaatcagtgtgtgtggagctgcaaaactctacttgggatcatctgtctttggttacctcctatttctttccctgtttgcactgggctgtgaaaattctgatgtggcaggactaactgtctcctaccaaggaaccaaacctgtctcttatcatgaacgagctctcttttcagattgcaactcaagatgcaaatgttcagagacaaaatgggaacccatgtgcggtgaaaatggaatcacatatgtatcagcttgtcttgctggttgtcaaacctccaacaggagtggaaaaaatattatattttacaactgcacttgtgtgggaattgcagcttctaaatccggaaattcctcaggcatagtgggaagatgtcagaaagacaatggatgtccccaaatgtttctgtatttccttgtaatttcagtcatcacatcctatactttatccctaggtggcatacctggatacatattacttctgaggtgcattaagccacagcttaagtcttttgccttgggtatctacacattagcaataagagttcttgcaggaatcccagctccagtgtattttggagttttgattgatacttcatgcctcaaatggggatttaaaagatgtggaagtagaggatcatgcagattatatgattcaaatgtcttcaggtaccaaatcaaaagcattcccgcatctcattgctacagcatcccagatttacacaatgccactgacactaacaagttttcatgtcatttcactgcttgtaagacatatatatctgggactaactgtgatactgggcacagtgtcaattctcctaagcattgcagtacttttcattttaaagaaaaattatgtttcaaaacacagaagttttataaccaagagagaaagaacaatggtgtctacaagattccaaaaggaaaattacactacaagtgatcatctgctacaacccaactactggccaggcaaggaaactcaactttagaaacatgatgactggaagtcatgtcttctaattggttgacattttgcaaacaaataaattgtaatcaaaagagctctaaatttgtaatttctttctcctttcaaaaaatgtctactttgttttggtcctaggcattaggtaatataactgataatatactgaaacatataatggaagatgcagatgataaaactaattttgaactttttaatttatataaattattttatatcacttacttatttcactttattttgctttgtgctcattgatatatattagctgtactcctagaagaacaattgtctctattgtcacacatggttatatttaaagtaatttctgaactgtgtaatgtgtctagagtaagcaaatactgctaacaattaactcataccttgggttccttcaagtattactcctatagtattttctcccatagctgtcttcatctgtgtattttaataatgatcttaggatggagcagaacatggagaggaagatttcattttaagctcctccttttctttgaaatacaataatttatatagaaatgtgtagcagcaaattatattggggattagaattttgaattaatagctctcctactattaatttacatgtgctttttgtgtggcgctataagtgactatggttgtaaagtaataaaattgatgttaacatgcccaattattgttcttttatgaatccaatgaatttaaaactattgttaaatataatactgccccactttaatatatgtaagcaacttcctacttatacacgacgtgttcctaaaacatgtttgaaaggtgaatttctgaaagtctacaataaatgtaggtgttacaacagg

SEQ ID NO: 29446 - DNA, 4223 bp, Homo sapiens
acacctgtctgagggggcggcggcggcggcggcggcggggcgggggctcgtagcgcctttgacacccgaggaaaagagggaggagggagagcgcgtttcatcatcggcggcggccacttataaaaacttctaggcgcgcactcgctggctcagtctccgctccgcgaatctcctccggccactgccgccgcggtcgcctctcacccgcccggccgctccagcccgaggcgccccgaccccgcgccactccgcgcccggccagccgcccgcagccatggggctcctgcccaagctcggcgcgtcccagggcagcgacacctctactagccgagccggccgctgtgcccgctcggtcttcggcaacattaaggtgtttgtgctctgccaaggcctcctgcagctctgccaactcctgtacagcgcctacttcaagagcagcctcaccaccattgagaagcgctttgggctctccagttcttcatcgggtctcatttccagcttgaatgagatcagcaatgccatcctcatcatctttgtcagctactttggcagccgggtgcaccgtccacgtctgattggcatcggaggtctcttcctggctgcaggtgccttcatcctcaccctcccacacttcctctccgagccctaccagtacaccttggccagcactgggaacaacagccgcttgcaggccgagctctgccagaagcattggcaggacctgcctcccagtaagtgccacagcaccacccagaacccccagaaggagaccagcagcatgtggggcctgatggtggttgcccagctgctggctggcatcgggacagtgcctattcagccatttgggatctcctatgtggatgacttctcagagcccagcaactcgcccctgtacatctccatcttatttgccatctctgtatttggaccggctttcgggtacctgctgggctctgtcatgctgcagatctttgtggactatggcagggtcaacacagctgcagttaacttggtcccgggtgacccccgatggattggagcctggtggctaggcctgctcatttcttcagctttattggttctcacctctttccccttttttttcttccctcgagcaatgcccataggagcaaagagggctcctgccacagcagatgaagcaaggaagttggaggaggccaagtcaagaggctccctggtggatttcattaaacggtttccatgcatctttctgaggctcctgatgaactcactcttcgtcctggtggtcctggcccagtgcaccttctcctccgtcattgctggcctctccaccttcctcaacaagttcctggagaagcagtatggcacctcagcagcctatgccaacttcctcattggtgctgtgaacctccctgctgcagccttggggatgctgtttggaggaatcctcatgaagcgctttgttttctctctacaagccattccccgcatagctaccaccatcatcaccatctccatgatcctttgtgttcctttgttcttcatgggatgctccaccccaactgtggccgaagtctacccccctagcacatcaagttctatacatccgcagtctcctgcctgccgcagggactgctcgtgcccagattctatcttccacccggtctgtggagacaatggaatcgagtacctctccccttgccatgccggctgcagcaacatcaacatgagctctgcaacctccaagcaactgatctatttgaactgcagctgtgtgaccgggggatccgcttcagcaaagacaggatcgtgccctgtcccctgtgcccacttcctgctcccggccatcttcctcatctccttcgtgtccctgatagcctgcatctcccacaaccccctctacatgatggttctgcgtgtggtgaaccaggaggaaaagtcatttgccatcggggtgcagttcttgttgatgcgcttgctggcctggctgccatctccagccctctatggcctcaccattgaccactcctgcatccggtggaactcgctgtgcttggggaggcgaggggcctgcgcctactatgacaacgatgctctccgagacaggtacctgggcctgcagatgggctacaaggcgctgggcatgctgctgctttgcttcatcagctggagggtgaagaagaacaaggagtacaacgtgcagaaggcggcaggcctcatctgaccccaccctgggccactgccctgctccagagagtggaccttgactcttccacacctgcctatactcactaatgttaacacgtcatttcctttttgtatttttaaacaagaaagaaaaccccagtcctcatttgccttccctacctcttcctcccagagtcctccccacagttcctaagggccactgtgtacccgggctgtgtgggccagaactggggggctgagtcttccctggccccttggaagaggcccccagatgcccaggctcacttcagtgttgagtcctccattgaggatgcccactgaggcagccaggcccctcaccagccctggggggaatcctaaacagagagagaaaaagggtatctgcccttcttgccaggcagctccactctcccgctgactgcccacaccctgcagagtggcaggggtgaaaggaagaaggaagtggctgagttattaatagccagagccactgggagactggggagactggctgtaacccccttcacacctgggtttggcatcagcacagactacgggaggggctggctccctccccctcagaccctcacttcctgtacctagaggccattctggatgctgccatgttgggaagtacagtctctgcccattacctgcatgcaggcaccagagcagggactgagaaaccccaaggatgggtcatctaagtgctgtccatatgaaccctggactttctgtccttagatcctcacatgttatccctgtctttctggggtacgtttcaaactgaggaagctacaacacagtgaagacccaaggaaggcctatgaaaaggtcctgatgcccaacctcccaccccttcaatgtggggacgagaccccctcatctcagagtaatgggaagaacctcccacatctccctggcagcagatgaggtggcttcacatgcacttccctgtctggacttcagcccgtattccgaggagtagagaggcagaagagatgtcagcaaagcaagtgatgaagcagagtggatgtccactgtcaccaagctggatggcaagctgcggcccacaaaacagccagtcaggttggctttcctggtttcagacatgctcataccattcccattttctcagcctcttctcactgcctccagagaggtgggtgcctgggttgagagacacagctgctacgtgatagatgttgagagacagaagccaacgaaggaggtcattcatcaacaaatatatttattggagaccgactttgtgcaaagcaatgctaatcagggttctccatggagcttccctcagctcttacctcacctccctccatttacattagggccttctcccagggtgtgctcggtgggcagtgtgggactgggggtgtgggagttggtgagagcaggaggagaggtggggacagcaagaagccacagattggcatgaaggatcctgacctgactatccatgccatccatggcccccagactgactctgcacctggccctttgccagacagctctgtctccccatgtcctctggaacagctgggcatgggtcatggccattcatgacccttaagtgccacccttcttggaagaccccctccagaagcatactggaagccacctctggaaaagcctcatatggtgatatgccaaaatatttatgtcaatgtccaaacaaagtccaatgccatgagactgaagtctttgtggaaaccactgttacagacaagcttatttccaaagccacctcatttccaaacatctcactcaggaagggaggctcaatgtaacctcaggggccagttttagcatttgaaatggttctgcttggaaaatgatgccctgcaactaaccctggtctttcccatggcaatttaaccacatttggaaggcactgccttcagctgagtttatgaacaatgaatgccaaccttcaggttctagaagattggttgcactcccaaacctttattctattatattactattaaaatattctaattttgctattgaggtaa

SEQ ID NO: 29447 - DNA, 1937 bp, Homo sapiens
tctccgctccgcgaatctcctccggccactgccgccgcggtcgcctctcacccgcccggccgctccagcccgaggcgccccgaccccgcgccactccgcgcccggccagccgcccgcagccatggggctcctgcccaagctcggcgcgtcccagggcagcgacacctctactagccgagccggccgctgtgcccgctcggtcttcggcaacattaaggtgtttgtgctctgccaaggcctcctgcagctctgccaactcctgtacagcgcctacttcaagagcagcctcaccaccattgagaagcgctttgggctctccagttcttcatcgggtctcatttccagcttgaatgagatcagcaatgccatcctcatcatctttgtcagctactttggcagccgggtgcaccgtccacgtctgattggcatcggaggtctcttcctggctgcaggtgccttcatcctcaccctcccacacttcctctccgagccctaccagtacaccttggccagcactgggaacaacagccgcttgcaggccgagctctgccagaagcattggcaggacctgcctcccagtaagtgccacagcaccacccagaacccccagaaggagaccagcagcatgtggggcctgatggtggttgcccagctgctggctggcatcgggacagtgcctattcagccatttgggatctcctatgtggatgacttctcagagcccagcaactcgcccctgtacatctccatcttatttgccatctctgtatttggaccggctttcgggtacctgctgggctctgtcatgctgcagatctttgtggactatggcagggtcaacacagctgcagttaacttggtcccgggtgacccccgatggattggagcctggtggctaggcctgctcatttcttcagctttattggttctcacctctttccccttttttttcttccctcgagcaatgcccataggagcaaagagggctcctgccacagcagatgaagcaaggaagttggaggaggccaagtcaagaggctccctggtggatttcattaaacggtttccatgcatctttctgaggctcctgatgaactcactcttcgtcctggtggtcctggcccagtgcaccttctcctccgtcattgctggcctctccaccttcctcaacaagttcctggagaagcagtatggcacctcagcagcctatgccaacttcctcattgcacatcaagttctatacatccgcagtctcctgcctgccgcagggactgctcgtgcccagattctatcttccacccggtctgtggagacaatggaatcgagtacctctccccttgccatgccggctgcagcaacatcaacatgagctctgcaacctccaagcaactgatctatttgaactgcagctgtgtgaccgggggatccgcttcagcaaagacaggatcgtgccctgtcccctgtgcccacttcctgctcccggccatcttcctcatctccttcgtgtccctgatagcctgcatctcccacaaccccctctacatgatggttctgcgtgtggtgaaccaggaggaaaagtcatttgccatcggggtgcagttcttgttgatgcgcttgctggcctggctgccatctccagccctctatggcctcaccattgaccactcctgcatccggtggaactcgctgtgcttggggaggcgaggggcctgcgcctactatgacaacgatgctctccgagacaggtacctgggcctgcagatgggctacaaggcgctgggcatgctgctgctttgcttcatcagctggagggtgaagaagaacaaggagtacaacgtgcagaaggcggcaggcctcatctgaccccaccctgggccactgccctgctccagagagtggaccttgactcttccacacctgcctatactcactaatgt

SEQ ID NO: 29448 - DNA, 5115 bp, Homo sapiens
ggaggaggaaggggcgatcgcggcggcggcggcggcggcgaggagctgtgccttccacctctccagccccggcaggacgggggcggccgccgcgaacccggggcggggacagcacgcagcctcgaggcgcgcacccccgcccggcagcggccccgacacccggggcgagcgggaaagcggcagcggcggcggcggcggcggcggcgggggaaggatgcaggggaagaagccgggcggttcgtcgggcggcggccggagcggcgagctgcagggggacgaggcgcagaggaacaagaaaaagaaaaagaaggtgtcctgcttttccaacatcaagatcttcctggtgtccgagtgcgccctgatgctggcgcagggcacggtgggcgcctacctggtgagcgtcctgaccaccctggagcgtaggttcaacctgcagagcgctgacgtgggtgtgatcgctagcagcttcgagatcgggaacctggcgctcatcctcttcgtgagctacttcggggcacgcgggcaccggccgcgcctgatcggctgcggcggcatcgtcatggcgctgggcgcgctgctgtcggcgctgcccgagttcctgacccaccagtacaagtacgaggcgggcgagatccgctggggcgccgagggccgcgacgtctgcgcagccaacggctcgggcggcgacgaggggcccgaccccgacctcatctgccgcaaccggacggctaccaacatgatgtacttgctgctcattggggcccaggtgctcctgggcatcggtgctacccctgtgcagcccctgggcgtctcctacatcgacgaccacgtgcggaggaaggactcctcgctctatataggaatcctgttcacgatgctggtatttggaccagcctgcgggtttatcctgggctctttctgtaccaaaatctacgtggatgcggtcttcattgacacaagtaacctggacatcactccggacgacccccgctggatcggagcctggtggggtggctttctgctctgcggtgccttactcttcttctcttccctcttgatgtttgggtttccacagtccctgcccccgcactcagagcccgccatggaaagcgagcaggccatgctctccgaaagagaatacgagagacccaagcccagcaacggggtcctgaggcaccccctggagccagacagcagtgcctcctgtttccagcagctgagagtgatcccgaaggtcaccaagcacctgctctcaaaccctgtgttcacctgcatcatcctggccgcctgcatggagattgcagtggtggctggcttcgctgcctttttggggaagtacctggagcagcagtttaacctcaccacctcttctgccaaccagctgcttgggatgactgcgatcccgtgtgcttgtctgggtatcttcctgggaggtcttttggtgaagaagctcagcctgtctgccctgggggccattcggatggccatgctcgtcaacctggtgtccactgcttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagaggccttcctcactttcctctgtgtgatgtgtatctgcagcctgatcggtgccatggcacagacaccctcagtcatcatcctcatcaggacagtcagccctgaactcaagtcttacgctttgggagttctttttctcctccttcgtttgttgggcttcatccctccacccctcatcttcggggctggcatcgactccacctgcctgttctggagcacgttctgtggggagcaaggcgcctgcgtcctctacgacaatgtggtctaccgatacctgtatgtcagcatcgccatcgcgctcaaatccttcgccttcatcctgtacaccaccacgtggcagtgcctgaggaaaaactataaacgctacatcaaaaaccacgagggcgggctgagcaccagtgagttctttgcctctactctgaccctagacaacctggggagggaccctgtgcccgcaaaccagacacataggacaaagtttatctataacctggaagaccatgagtggtgtgaaaacatggagtccgttttatagtgactaaaggagggctgaactctgtattagtaatccaagggtcatttttttcttaaaaaaagaaaaaaaggttccaaaaaaaaccaaaactcagtacacacacacaggcacagatgcacacacacgcagacagacacaccgactttgtcctttttctcagcatcagagccagacaggattcagaataaggagagaatgacatcgtgcggcagggtcctggaggccacttgcgcggctgggccacagagtctactttgaaggcacctcatggttttcaggatgctgacagctgcaagcaacaggcactgccaaattcagggaacagtggtggccagcttggaggatggacatttctggatacacatacacatacaaaacagaaaacattttttaaaagaagtttcctaaaataaaaaaaattaaaaaaaaaaaacccacaagttgaaaacattgccagattaagcactagtgacacaccccgtgccaccctcttcctccaggtgggggtgggggcgggcgcacaagtcggaggggtggaagcaccactcctctctctgactttcgcaatatgggtcactgtgtagacgactcacccagtctgcatgtggttcaaggccccagagttctctcagtgatgctaatgggtgatccgtgctggagtttgtaattggcacctctcaccagctccatttccatgttcaagactgagggcctgagggggagccaggtggggggccagcacctcccagtggcgggcatccaccttcccccagccccacagagtgacctcaggaagcagtaggcctcgcctggctatgactgacccggctcagagctggtgagacccaacgcagtccaagtcatttgcttacatttgccaaaaacattttgccatttttaaaagaaaaaaatacaatccatatgaatttcaaactgttgtatgtataatcctctaatactatttttaactacttctaaaatctgtgttaacccttcaagtcactaacacagttctctaggccggatttattatgctggttgcttttactttttttctccttttttaatgcaccaaaaatatgtgatacaagggatgcaattaacctattgtaattttcatcattttatcctcattcgaatattctacaaaaacaagaatatacaatgtgttacaagaagaaaaaaaaatgcttcaaaaagagagtgtatatgcagcctgcctttaaaagaatcacatttgagacaacaggggataatgtgatgaattgcaaatttgccttttagcttccttccccatgattcagtgatcactgtcacgggaaacccttttatattcatgcttgacattccaagaggcgttcttttcagcctgtggaggagacactcttagatgtgggtttgtgtgtatgggtgcaacacttccggggataggaaagaagaacagttccctaacacaagctgttaagaagtctgtagcatctctgataacgaatagacccacaagctcctggaagctgtcgtgtgtccaatgcgtgaaaatgtctgtgacattttcagtgttagtcttgaactaaggcccttgtctgtgtgttttgaaggtgggtgaacctcagagaatgaacctgttatgatttggggtaagaatcacgttggaaaacctctcgcaaccagcacactaggccttctacggccatttctgtaaggggacagagcttaggtaaaggcacacactcatacacacacaacaaagggccctgctaacttactcctcatgctgcttcagtgacctttgttcatgtcacattcctggcgctggaaaaaaaactcaaaggttgattggtttgctttttcaccttggacacatttgcattttacccacaaggcaaacaaaagaatcaggaagtaaaaaatggttgggagtgggacaggtatggtaccgaatttttaatgaacattgtaaatgaagaggcttgaatgacagcccaaatctagagaaggcactcagcaagaccaaccaaaagaaaagctgtgtcgtggtatggggccaccgtgatcagctacctggggcaggatgcttctgagacaggcctttcaactgcttagtgttagtatgtccttgcttatgaaaatggggacactcatcagtacgttaactactaaaggggagatggttctccaaccacttcataaaatatgtatgttctgttgttcctaaggctttgataatatcctgtacagattttggtttagttttgcaaatatattgctaataggtcactcttatagattattgcttggcccttcaaactcagtacacacacactgaggccctttgacctagtgttttatggaactatttgctttgagagaaaaaaaaaagaaagttttttaaactctttgcattttggattttttttcctaagattttaggatgaatgtgaaaaagatgttagaataacaggaagacaactccagggctgagttttatcagcaattgggtataaatttaaagaccgctgttgcaggatggctctgaattctgttgtgtcgtcttttaaaattttaattattctcatatagtaccgaacagaaaactcagtctagttttaatttgccttttgtgctctaaagaagcattgtacatacaacactagatccagcccctcgattatctgtttggtttcaagtgaatgaaaagatttcctggtaagatcattggatttacagaatacaaaaatgtacgggatggaataaacctagaaagtgaa

SEQ ID NO: 29449 - DNA, 2776 bp, Homo sapiens
ctgcggcgggggcggccccagcggatgaatgaagcggcgcgtggctgccggggaggccagagcgtggagcgctgcgcggcgcggcggccgggccctcgagacggggacggacacaccagcccctcggataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggtgggcctgcagcctgaggaaggcttgtgtgtcctcagttaaaactgtgcatatcgaaatatattttgttatttaagcctgcg

SEQ ID NO: 29450 - DNA, 1749 bp, Homo sapiens
atgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctgggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaa

SEQ ID NO: 29451 - DNA, 2665 bp, Homo sapiens
gacacaccagcccctcggataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacgatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggtgggcctgcagcctgaggaaggcttgtgtgtcctcagttaaaactgtgcatatcgaaatatattttgttatttaagcctg

SEQ ID NO: 29452 - DNA, 2732 bp, Homo sapiens
ggctgccggggaggccagagcgtggagcgctgcgcggcgcggcggccgggccctcgagacggggacggacacaccagcccctcggataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgtaccgagactgtagctgtatccctcagaatctttcctctggttttggccatgccactgcagggaaatgcacttcaacttttctttacattcctcagcagcattcctgcactaacggcaactctacgacaggagcactccaggaaacacccaggtctaagcgggcctgcagatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggtgggcctgcagcctgaggaaggcttgtgtgtcctcagttaaaactgtgcatatcgaaatatattttgttatttaagcctg

SEQ ID NO: 29453 - DNA, 856 bp, Homo sapiens
actacagccctgtgtgcggctcggacggcctcatgtacttctcactgtgccacgcagggtgccctgcagccacggagacgaatgtggacggccagaagatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggtgggcctgcagcctgaggaaggcttgtgtgtcctcagttaaaactgtgcatatcgaaatatattttgttatttaagcctg

SEQ ID NO: 29454 - DNA, 3092 bp, Homo sapiens
gcggcgcggcggccgggccctcgagacggggacggacacaccagcccctcggataccacttggccactcccgctgaggccactcccactgcgtggctgaagcctcgaggtcaccaggcggaggcgcggagatgcccctgcatcagctgggggacaagccgctcaccttccccagccccaactcagccatggaaaacgggcttgaccacaccccacccagcaggagggcatccccgggcacacccctgagccccggctccctccgctccgctgcccatagccccctggacaccagcaagcagcccctctgccagctctgggccgagaagcatggcgcccgggggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacccctctacacgctgggcgtcacctacctggatgagaacgtcaagtccagctgctcgcccgtctacattgccatcttctacacagcggccatcctgggcccagctgccggctacctgattggaggtgccctgctgaatatctacacggaaatgggccgacggacggagctgaccaccgagagcccactgtgggtcggcgcctggtgggtcggcttcctgggctctggggccgctgctttcttcaccgccgttcccatccttggttaccctcggcagctgccaggctcccagcgctacgcggtcatgagagcggcggaaatgcaccagttgaaggacagcagccgtggggaggcgagcaacccggactttgggaaaaccatcagagacctgcctctctccatctggctcctgctgaagaaccccacgttcatcctgctctgcctggccggggccaccgaggccactctcatcaccggcatgtccacgttcagccccaagttcttggagtcccagttcagcctgagtgcctcagaagctgccaccttgtttgggtacctggtggtgccagcgggtggtggcggcaccttcctgggcggcttctttgtgaacaagctcaggctccggggctccgcggtcatcaagttctgcctgttctgcaccgttgtcagcctgctgggcatcctcgtcttctcactgcactgccccagtgtgcccatggcgggcgtcacagccagctacggcgggagcctcctgcccgaaggccacctgaacctaacggctccctgcaacgctgcctgcagctgccagccagaacactacagccctgtgtgcggctcggacggcctcatgtacttctcactgtgccacgcagggtgccctgcagccacggagacgaatgtggacggccagaaggtgagtggagccgctgcctaccgcccctgtcctcccctggaccctgggaaggggcccccgtgccttccccttgtaatcggagctattgttgggcttcccaggtgtaccgagactgtagctgtatccctcagaatctttcctctggttttggccatgccactgcagggaaatgcacttcaacttgtcagagaaagcccctccttctggttttcatattcgttgtaattttctttacattcctcagcagcattcctgcactaacggcaactctacggtaagctggggtcgggtgtgcgcttgtccagagctttccttgcagcaccctgaggcggagctctgcagatcctgagacaggagcactccaggaaacacccaggtctaagcgggcctgtctgtcactggtggcaggagagacctcactgtctctgatctctgacgaggggcttcccacttgggggggggtgatgatgtggctggggactggtccaggaggccactggcctagggggtgacttggcatgcaaccccacttctgtgggtgctgacgctgtggttttctattgcagatgtgtccgtgaccctcagagatcctttgccctgggaatccagtggattgtagttagaatactagggggcatcccggggcccatcgccttcggctgggtgatcgacaaggcctgtctgctgtggcaggaccagtgtggccagcagggctcctgcttggtgtaccagaattcggccatgagccgctacatactcatcatggggctcctgtacaaggtgctgggcgtcctcttctttgccatagcctgcttcttatacaagcccctgtcggagtcttcagatggcctggaaacttgtctgcccagccagtcctcagcccctgacagtgccacagatagccagctccagagcagcgtctgaccaccgcccgcgcccacccggccacggcgggcactcagcatttcctgatgacagaacagtgccgttgggtgatgcaatcacacgggaacttctatttgacctgcaaccttctacttaacctgtggtttaaagtcggctgtgacctcctgtccccagagctgtacggccctgcagtgggtgggaggaacttgcataaatatatatttatggacacacagtttgcatcagaacgtgtttatagaatgtgttttatacccgatcgtgtgtggtgtgcgtgaggacaaactccgcaggggctgtgaatcccactgggagggcggtgggcctgcagcctgaggaaggcttgtgtgtcctcagttaaaactgtgcatatcgaaatatattttgttatttaagcctg

SEQ ID NO: 29455 - DNA, 2437 bp, Homo sapiens
gcttgggcggcaagagccccttgtggccaccgagtcctccgacgccctcgccaggctggcctttgggttggcccaggcaggacgggcagccgagagcactcgggccgcgtcgccaggagccgcccagggtgagccatgttcgtaggcgtcgcccggcactctgggagccaggatgaagtctcaaggggagtagagccgctggaggccgcgcgggcccagcctgctaaggacaggagggccaagggaaccccgaagtcctcgaagcccgggaaaaaacaccggtatctgagactacttccagaggccttgataaggttcggcggtttccgaaaaaggaaaaaagccaagtcctcagtttccaagaagccgggagaagtggatgacagtttggagcagccctgtggtttgggctgcttagtcagcacctgctgtgagtgttgcaataacattcgctgcttcatgattttctactgcatcctgctcatatgtcaaggtgtggtgtttggtcttatagatgtcagcattggcgattttcagaaggaatatcaactgaaaaccattgagaagttggcattggaaaagagttacgatatttcatctggcctggtagcaatatttatagcattctatggagacagaaaaaaagtaatatggtttgtagcttcctcctttttaataggacttggatcacttttatgtgcttttccatccattaatgaagaaaataaacaaagtaaggtaggaattgaagatatttgcgaagaaataaaggttgtcagtggttgccagagcagtggtatatcattccaatcaaaatacctgtctttcttcatccttgggcagactgtgcagggaatagcaggaatgcctctttatatccttggaataacctttattgatgagaatgttgctacacactcagctggtatctatttaggtattgcagaatgtacatcaatgattggatatgctctgggttatgtgctaggagcaccactagttaaagtccctgagaatactacttctgcaacaaacactacagtcaataatggtagtccagaatggctatggacttggtggattaattttctttttgccgctgtcgttgcatggtgtacattaataccattgtcatgctttccaaacaatatgccaggttcaacacggataaaagctaggaaacgtaaacagcttcatttttttgacagcagacttaaagatctgaaacttggaactaatatcaaggatttatgtgctgctctttggattctgatgaagaatccagtgctcatatgcctagctctgtcaaaagctacagaatatttagttattattggagcttctgaatttttgcctatatatttagaaaatcagtttatattaacacccactgtggcaactacacttgcaggacttgttttaattccaggaggtgcacttggccagcttctgggaggtgtcattgtttccacattagaaatgtcttgtaaagcccttatgagatttataatggttacatctgtgatatcacttatactgcttgtgtttattatttttgtacgctgtaatccagtgcaatttgctgggatcaatgaagattatgatggaacagggaagttgggaaacctcacggctccttgcaatgaaaaatgtagatgctcatcttcaatttattcttctatatgtggaagagatgatattgaatatttttctccctgctttgcagggtgtacatattctaaagcacaaaaccaaaaaaagatgtactacaattgttcttgcattaaagaaggattaataactgcagatgcagaaggtgattttattgatgccagacccgggaaatgtgatgcaaagtgctataagttacctttgttcattgcttttatcttttctacacttatattttctggtttttctggtgtaccaatcgtcttggccatgacgcgggttgtacctgacaaactgcgttctctggccttgggtgtaagctatgtgattttgagaatatttgggactattcctggaccatcaatctttaaaatgtcaggagaaacttcttgtattttacgggatgttaataaatgtggacacacaggacgttgttggatatataacaagacaaaaatggctttcttattggtaggaatatgttttctttgcaaactatgcactatcatcttcactactattgcatttttcatatacaaacgtcgtctaaatgagaacactgacttcccagatgtaactgtgaagaatccaaaagttaagaaaaaagaagaaactgacttgtaactggatcatcattgtattctccaagatttgtttctgtgcccaactttcagaagaggaaaatcacacattatgtttacataagtagcaaaaatatatttatggtgatctgcattttcataataaagtgtcctattgtgaaaca

SEQ ID NO: 29456 - DNA, 1762 bp, Homo sapiens
tttgcctcctgccctaggagaaacgttcgctctggaggcttgggcggcaagagccccttgtggccaccgagtcctccgacgccctcgccaggctggcctttgggttggcccaggcaggacgggcagccgagagcactcgggccgcgtcgccaggagccgcccagggtgagccatgttcgtaggcgtcgcccggcactctgggagccaggatgaagtctcaaggggagtagagccgctggaggccgcgcgggcccagcctgctaaggacaggagggccaagggaaccccgaagtcctcgaagcccgggaaaaaacaccggtatctgagactacttccagaggccttgataaggttcggcggtttccgaaaaaggaaaaaagccaagtcctcagtttccaagaagccgggagaagtggatgacagtttggagcagccctgtggtttgggctgcttagtcagcacctgctgtgagtgttgcaataacattcgctgcttcatgattttctactgcatcctgctcatatgtcaaggtgtggtgtttggtcttatagatgtcagcattggcgattttcagaaggaatatcaactgaaaaccattgagaagttggcattggaaaagagttacgatatttcatctggcctggtagcaatatttatagcattctatggagacagaaaaaaagtaatatggtttgtagcttcctcctttttaataggacttggatcacttttatgtgcttttccatccattaatgaagaaaataaacaaagtaaggtaggaattgaaggtattgcagaatgtacatcaatgattggatatgctctgggttatgtgctaggagcaccactagttaaagtccctgagaatactacttctgcaacaaaaacagggaagttgggaaacctcacggctccttgcaatgaaaaatgtagatgctcatcttcaatttattcttctatatgtggaagagatgatattgaatatttttctccctgctttgcagggtgtacatattctaaagcacaaaaccaaaaaaagatgtactacaattgttcttgcattaaagaaggattaataactgcagatgcagaaggtgattttattgatgccagacccgggaaatgtgatgcaaagtgctataagttacctttgttcattgcttttatcttttctacacttatattttctggtttttctggtgtaccaatcgtcttggccatgacgcgggttgtacctgacaaactgcgttctctggccttgggtgtaagctatgtgattttgagaatatttgggactattcctggaccatcaatctttaaaatgtcaggagaaacttcttgtattttacgggatgttaataaatgtggacacacaggacgttgttggatatataacaagacaaaaatggctttcttattggtaggaatatgttttctttgcaaactatgcactatcatcttcactactattgcatttttcatatacaaacgtcgtctaaatgagaacactgacttcccagatgtaactgtgaagaatccaaaagttaagaaaaaagaagaaactgacttgtaactggatcatcattgtgattgcagatcatttgaggatcagagtgtgaaaacgagtttctcttttacagattctccaagatttgtttctgtgcccaactttcagaagaggaaaatcacacattatgtttacataagtagcaaaaatatatttatggtgatctgcattttcataataaagtgtcctattgtg

SEQ ID NO: 29457 - DNA, 2340 bp, Homo sapiens
tttgcctcctgccctaggagaaacgttcgctctggaggcttgggcggcaagagccccttgtggccaccgagtcctccgacgccctcgccaggctggcctttgggttggcccaggcaggacgggcagccgagagcactcgggccgcgtcgccaggagccgcccagggtgagccatgttcgtaggcgtcgcccggcactctgggagccaggatgaagtctcaaggggagtagagccgctggaggccgcgcgggcccagcctgctaaggacaggagggccaagggaaccccgaagtcctcgaagcccgggaaaaaacaccggtatctgagactacttccagaggccttgataaggttcggcggtttccgaaaaaggaaaaaagccaagtcctcagtttccaagaagccgggagaagtggatgacagtttggagcagccctgtggtttgggctgcttagtcagcacctgctgtgagtgttgcaataacattcgctgcttcatgattttctactgcatcctgctcatatgtcaaggtgtggtgtttggtcttatagatgtcagcattggcgattttcagaaggaatatcaactgaaaaccattgagaagttggcattggaaaagagttacgatatttcatctggcctggtagcaatatttatagcattctatggagacagaaaaaaagtaatatggtttgtagcttcctcctttttaataggacttggatcacttttatgtgcttttccatccattaatgaagaaaataaacaaagtaaggtaggaattgaaggtattgcagaatgtacatcaatgattggatatgctctgggttatgtgctaggagcaccactagttaaagtccctgagaatactacttctgcaacaaacactacagtcaataatggtagtccagaatggctatggacttggtggattaattttctttttgccgctgtcgttgcatggtgtacattaataccattgtcatgctttccaaacaatatgccaggttcaacacggataaaagctaggaaacgtaaacagcttcatttttttgacagcagacttaaagatctgaaacttggaactaatatcaaggatttatgtgctgctctttggattctgatgaagaatccagtgctcatatgcctagctctgtcaaaagctacagaatatttagttattattggagcttctgaatttttgcctatatatttagaaaatcagtttatattaacacccactgtggcaactacacttgcaggacttgttttaattccaggaggtgcacttggccagcttctgggaggtgtcattgtttccacattagaaatgtcttgtaaagcccttatgagatttataatggttacatctgtgatatcacttatactgcttgtgtttattatttttgtacgctgtaatccagtgcaatttgctgggatcaatgaagattatgatggaacagggaagttgggaaacctcacggctccttgcaatgaaaaatgtagatgctcatcttcaatttattcttctatatgtggaagagatgatattgaatatttttctccctgctttgcagggtgtacatattctaaagcacaaaaccaaaaaaagatgtactacaattgttcttgcattaaagaaggattaataactgcagatgcagaaggtgattttattgatgccagacccgggaaatgtgatgcaaagtgctataagttacctttgttcattgcttttatcttttctacacttatattttctggtttttctggtgtaccaatcgtcttggccatgacgcgggttgtacctgacaaactgcgttctctggccttgggtgtaagctatgtgattttgagaatatttgggactattcctggaccatcaatctttaaaatgtcaggagaaacttcttgtattttacgggatgttaataaatgtggacacacaggacgttgttggatatataacaagacaaaaatggctttcttattggtaggaatatgttttctttgcaaactatgcactatcatcttcactactattgcatttttcatatacaaacgtcgtctaaatgagaacactgacttcccagatgtaactgtgaagaatccaaaagttaagaaaaaagaagaaactgacttgtaactggatcatcattgtgattgcagatcatttgaggatcagagtgtgaaaacgagtttctcttttacagattctccaagatttgtttctgtgcccaactttcagaagaggaaaatcacacattatgtttacataagtagcaaaaatatatttatggtgatctgcattttcataataaagtgtcctattgtgaaaca

SEQ ID NO: 29458 - DNA, 2689 bp, Homo sapiens
tttgcctcctgccctaggagaaacgttcgctctggaggcttgggcggcaagagccccttgtggccaccgagtcctccgacgccctcgccaggctggcctttgggttggcccaggcaggacgggcagccgagagcactcgggccgcgtcgccaggagccgcccagggtgagccatgttcgtaggcgtcgcccggcactctgggagccaggatgaagtctcaaggggagtagagccgctggaggccgcgcgggcccagcctgctaaggacaggagggccaagggaaccccgaagtcctcgaagcccgggaaaaaacaccggtatctgagactacttccagaggccttgataaggttcggcggtttccgaaaaaggaaaaaagccaagtcctcagtttccaagaagccgggagaagtggatgacagtttggagcagccctgtggtttgggctgcttagtcagcacctgctgtgagtgttgcaataacattcgctgcttcatgattttctactgcatcctgctcatatgtcaaggtgtggtgtttggtcttatagatgtcagcattggcgattttcagaaggaatatcaactgaaaaccattgagaagttggcattggaaaagagttacgatatttcatctggcctggtagcaatatttatagcattctatggagacagaaaaaaagtaatatggtttgtagcttcctcctttttaataggacttggatcacttttatgtgcttttccatccattaatgaagaaaataaacaaagtaaggtaggaattgaagatatttgcgaagaaataaaggttgtcagtggttgccagagcagtggtatatcattccaatcaaaatacctgtctttcttcatccttgggcagactgtgcagggaatagcaggaatgcctctttatatccttggaataacctttattgatgagaatgttgctacacactcagctggtatctatttaggtattgcagaatgtacatcaatgattggatatgctctgggttatgtgctaggagcaccactagttaaagtccctgagaatactacttctgcaacaaacactacagtcaataatggtagtccagaatggctatggacttggtggattaattttctttttgccgctgtcgttgcatggtgtacattaataccattgtcatgctttccaaacaatatgccaggttcaacacggataaaagctaggaaacgtaaacagcttcatttttttgacagcagacttaaagatctgaaacttggaactaatatcaaggatttatgtgctgctctttggattctgatgaagaatccagtgctcatatgcctagctctgtcaaaagctacagaatatttagttattattggagcttctgaatttttgcctatatatttagaaaatcagtttatattaacacccactgtggcaactacacttgcaggacttgttttaattccaggaggtgcacttggccagcttctgggaggtgtcattgtttccacattagaaatgtcttgtaaagcccttatgagatttataatggttacatctgtgatatcacttatactgcttgtgtttattatttttgtacgctgtaatccagtgcaatttgctgggatcaatgaagattatgatggaacagggaagttgggaaacctcacggctccttgcaatgaaaaatgtagatgctcatcttcaatttattcttctatatgtggaagagatgatattgaatatttttctccctgctttgcagggtgtacatattctaaagcacaaaaccaaaaaaagatgtactacaattgttcttgcattaaagaaggattaataactgcagatgcagaaggtgattttattgatgccagacccgggaaatgtgatgcaaagtgctataagttacctttgttcattgcttttatcttttctacacttatattttctggtttttctggtgtaccaatcgtcttggccatgacgcgggttgtacctgacaaactgcgttctctggccttgggtgtaagctatgtgattttgagaatatttgggactattcctggaccatcaatctttaaaatgtcaggagaaacttcttgtattttacgggatgttaataaatgtggacacacaggacgttgttggatatataacaagacaaaaatggctttcttattggtaggaatatgttttctttgcaaactatgcactatcatcttcactactattgcatttttcatatacaaacgtcgtctaaatgagaacactgacttcccagatgtaactgtgaagaatccaaaagttaagaaaaaagaagaaactgacttgtaactggatcatcattgtgattgcagatcatttgaggatcagagtgtgaaaacgagtttctcttttacagattctccaagatttgtttctgtgcccaactttcagaagaggaaaatcacacattatgtttacataagtagcaaaaatatatttatggtgatctgcattttcataataaagtgtcctattgtgaaacatttctgataatgtttttaatgtatgtagaatttttaggatttactgggagaattaaagtttaataattttagattatttacatttcttcttaatattctgctgtctagaaatattaaaaattatacaactaggaaataaagtaaaataataacattcaaagcc

SEQ ID NO: 29459 - DNA, 432 bp, Homo sapiens
ctaaatgagaacactgacttcccagatgtaactgtgaagaatccaaaagttaagaaaaaagaagaaactgacttgtaactggatcatcattgtcaggattgcagatcatttgaggatcagagtgtgaaaacgagtttctcttttacagattctccaagatttgtttctgtgcccaactttcagaagaggaaaatcacacattatgtttacataagtagcaaaaatatatttatggtgatctgcattttcataataaagtgtcctattgtgaaacatttctgataatgtttttaatgtatgtagaatttttaggatttactgggagaattaaagtttaataattttagattatttacatttcttcttaatattctgctgtctagaaatattaaaaattatacaactaggaaataaagtaaaataataacattc

SEQ ID NO: 29460 - DNA, 1611 bp, Homo sapiens
gttggcccaggcaggacgggcagccgagagcactcgggccgcgtcgccaggagccgcccagggtgagccatgttcgtaggcgtcgcccggcactctgggagccaggatgaagtctcaaggggagtagagccgctggaggccgcgcgggcccagcctgctaaggacaggagggccaagggaaccccgaagtcctcgaagcccgggaaaaaacaccggtatctgagactacttccagaggccttgataaggttcggcggtttccgaaaaaggaaaaaagccaagtcctcagtttccaagaagccgggagaagtggatgacagtttggagcagccctgtggtttgggctgcttagtcagcacctgctgtgagtgttgcaataacattcgctgcttcatgattttctactgcatcctgctcatatgtcaaggtgtggtgtttggtcttatagatgtcagcattggcgattttcagaaggaatatcaactgaaaaccattgagaagttggcattggaaaagagttacgatatttcatctggcctggtagcaatatttatagcattctatggagacagaaaaaaagtaatatggtttgtagcttcctcctttttaataggacttggatcacttttatgtgcttttccatccattaatgaagaaaataaacaaagtaaggtaggaattgaaggtattgcagaatgtacatcaatgattggatatgctctgggttatgtgctaggagcaccactagttaaagtccctgagaatactacttctgcaacaaaaacagggaagttgggaaacctcacggctccttgcaatgaaaaatgtagatgctcatcttcaatttattcttctatatgtggaagagatgatattgaatatttttctccctgctttgcagggtgtacatattctaaagcacaaaaccaaaaaaagatgtactacaattgttcttgcattaaagaaggattaataactgcagatgcagaaggtgattttattgatgccagacccgggaaatgtgatgcaaagtgctataagttacctttgttcattgcttttatcttttctacacttatattttctggtttttctggtgtaccaatcgtcttggccatgacgcgggttgtacctgacaaactgcgttctctggccttgggtgtaagctatgtgattttgagaatatttgggactattcctggaccatcaatctttaaaatgtcaggagaaacttcttgtattttacgggatgttaataaatgtggacacacaggacgttgttggatatataacaagacaaaaatggctttcttattggtaggaatatgttttctttgcaaactatgcactatcatcttcactactattgcatttttcatatacaaacgtcgtctaaatgagaacactgacttcccagatgtaactgtgaagaatccaaaagttaagaaaaaagaagaaactgacttgtaactggatcatcattgtattctccaagatttgtttctgtgcccaactttcagaagaggaaaatcacacattatgtttacataagtagcaaaaatatatttatggtgatctgcattttcataataaagtgtcctattgtgaaac

SEQ ID NO: 29461 - DNA, 618 bp, Homo sapiens
agcacacaagccgctttaggagcgaggttcggagccatcgctgctgcctgctgatccgcgcctagagtttgaccagccactctccagctcggctttcgcggcgccgagatgctgtcctgccgcctccagtgcgcgctggctgcgctgtccatcgtcctggccctgggctgtgtcaccggcgctccctcggaccccagactccgtcagtttctgcagaagtccctggctgctgccgcggggaagcaggaactggccaagtacttcttggcagagctgctgtctgaacccaaccagacggagaatgatgccctggaacctgaagatctgtcccaggctgctgagcaggatgaaatgaggcttgagctgcagagatctgctaactcaaacccggctatggcaccccgagaacgcaaagctggctgcaagaatttcttctggaagactttcacatcctgttagctttcttaactagtattgtccatatcagacctctgatccctcgcccccacaccccatctctcttccctaatcctccaagtcttcagcgagacccttgcattagaaactgaaaactgtaaatacaaaataaaattatggtgaaattatgaaaaatgtgaa

SEQ ID NO: 29462 - DNA, 4295 bp, Homo sapiens
tggtcatcgcacggcggcagctcctcacctggatttagaagagctggcgtccccgcccgcccaagcctttaaactctcgtctgccagaacccgccaactctccaggcttagggccagtttccgcgattctaagagtaattgcgtgggcacctgtgctggggccaggcgcaaagaagggagttggtctgcgcgaagatcgtcaacctgctaacagaccgcacatgcactttgcaccgaccatctacgtctcagtctggaggttgcgcactttggctgctgacgcgctggtggtgcctattaatcatttaccagtccagagccgcgccagttaatggctgtgccgtgcggtgctcccacatcctggcctctcctctccacggtcgcctgtgcccgggcaccccggagctgcaaactgcagagcccaggcaaccgctgggctgtgcgccccgccggcgccggtaggagccgcgctccccgcagcggttgcgctctacccggaggcgctgggcggctgtgggctgcaggcaagcggtcgggtggggagggagggcgcaggcggcgggtgcgcgaggagaaagccccagccctggcagccccactggcccccctcagctgggatgttccccaatggcaccgcctcctctccttcctcctctcctagccccagcccgggcagctgcggcgaaggcggcggcagcaggggccccggggccggcgctgcggacggcatggaggagccagggcgaaatgcgtcccagaacgggaccttgagcgagggccagggcagcgccatcctgatctctttcatctactccgtggtgtgcctggtggggctgtgtgggaactctatggtcatctacgtgatcctgcgctatgccaagatgaagacggccaccaacatctacatcctaaatctggccattgctgatgagctgctcatgctcagcgtgcccttcctagtcacctccacgttgttgcgccactggcccttcggtgcgctgctctgccgcctcgtgctcagcgtggacgcggtcaacatgttcaccagcatctactgtctgactgtgctcagcgtggaccgctacgtggccgtggtgcatcccatcaaggcggcccgctaccgccggcccaccgtggccaaggtagtaaacctgggcgtgtgggtgctatcgctgctcgtcatcctgcccatcgtggtcttctctcgcaccgcggccaacagcgacggcacggtggcttgcaacatgctcatgccagagcccgctcaacgctggctggtgggcttcgtgttgtacacatttctcatgggcttcctgctgcccgtgggggctatctgcctgtgctacgtgctcatcattgctaagatgcgcatggtggccctcaaggccggctggcagcagcgcaagcgctcggagcgcaagatcaccttaatggtgatgatggtggtgatggtgtttgtcatctgctggatgcctttctacgtggtgcagctggtcaacgtgtttgctgagcaggacgacgccacggtgagtcagctgtcggtcatcctcggctatgccaacagctgcgccaaccccatcctctatggctttctctcagacaacttcaagcgctctttccaacgcatcctatgcctcagctggatggacaacgccgcggaggagccggttgactattacgccaccgcgctcaagagccgtgcctacagtgtggaagacttccaacctgagaacctggagtccggcggcgtcttccgtaatggcacctgcacgtcccggatcacgacgctctgagcccgggccacgcaggggctctgagcccgggccacgcaggggccctgagccaaaagagggggagaatgagaagggaaggccgggtgcgaaagggacggtatccagggcgccagggtgctgtcgggataacgtggggctaggacactgacagcctttgatggaggaacccaagaaaggcgcgcgacaatggtagaagtgagagctttgcttataaactgggaaggctttcaggctacctttttctgggtctcccactttctgttccttcctccactgcgcttactcctctgaccctccttctattttccctaccctgcaacttctatcctttcttccgcaccgtcccgccagtgcagatcacgaactcattaacaactcattctgatcctcagcccctccagtcgttatttctgtttgtttaagctgagccacggataccgccacgggtttccctcggcgttagtccctagccgcgcggggccgctgtccaggttctgtctggtgcccctactggagtcccgggaatgaccgctctccctttgcgcagccctaccttaaggaaagttggacttgagaaagatctaagcagctggtcttttctcctactcttgggtgaaggtgcatctttccctgccctcccctgtccccctctcgccgcccgcccgccaccaccactctcactccacccagagtagagccaggtgcttagtaaaataggtcccgcgcttcgaactccaggctttctggagttcccacccaagccctcctttggagcaaagaaggagctgagaacaagccgaatgaggagtttttataagattgcggggtcggagtgtgggcgcgtaataggaatcaccctcctactgcgcgttttcaaagaccaagcgctgggcgctcccgggccgcgcgtctgcgttaggcagggcagggtagtgcagggcacaccttccccggggttcggggttcggggttcggttgcagggctgcagcccgccttggctttctccctcacccaagtttccggaggagccgacctaaaagtaacaatagataaggtttcctgctccagtgtatctcaaaagaccgggcgccaggggcgggggacctagggcgacgtcttcagagtccgccagtgttggcggtgtcgccgcaacctgcaggctcccgagtggggcctgcctggtctctagagggttgctgcctttcaagcggtgcctaagaagttattttcttgtttaacatatatatttattaatttatttgtcgtgttggaaaatgtgtctctgctttccttttctctgcttgcctagccccaggtcttttctttgggaccctgggggcgggcatggaagtggaagtaggggcaagctcttgccccactccctggccatctcaacgcctctcctcaatgctgggccctcttatctcatcctttcctctagcttttctatttttgattgtgttgagtgaagtttggagatttttcatacttttcttactatagtctcttgtttgtcttattaggataatacataaatgataatgtgggttatcctcctctccatgcacagtggaaagtcctgaactcctggctttccaggagacatatataggggaacatcaccctatatataatttgagtgtatatatatttatatatatgatgtggacatatgtatacttatcttgctccattgtcatgagtccatgagtctaagtatagccactgatggtgacaggtgtgagtctggctggaacactttcagtttcaggagtgcaagcagcactcaaacctggagctgaggaatctaattcagacagagactttaatcactgctgaagatgcccctgctccctctgggttccagcagaggtgattcttacatatgatccagttaacatcatcactttttttgaggacattgaaagtgaaataatttgtgtctgtgtttaatattaccaactacattggaagcctgagcagggcgaggaccaataattttaattatttatatttcctgtattgctttagtatgctggcttgtacatagtaggcactaaatacatgtttgttggttgattgtttaagccagagtgtattacaacaatctggagatactaaatctggggttctcaggttcactcattgacatgatatacaatggttaaaatcactattgaaaaatacgttttgtgtatatttgcttcaacaactttgtgctttcctgaaagcagtaaccaagagttaagatatccctaatgttttgcttaaactaatgaacaaatatgctttgggtcataaatcagaaagtttagatctgtcccttaataaaaatatatattactactcctttggaaaatagatttttaatggttaagaactgtgaaatttacaaatcaaaatcttaatcattatccttctaagaggatacaaatttagtgctcttaacttgttaccattgtaatattaactaaataaacagatgtattatgctgttgcaa

SEQ ID NO: 29463 - DNA, 4099 bp, Homo sapiens
tccctgtcacgcatctctcatcactccccctcattctgcctttcctcctactcacggtctcctctccctctccctctctctctctccccctccctctttctctctctctctctttctccacctcctcccgaccccctttcccctctatttctattggcttctgtgtcccttgctcccctcttctcttcctcaccctgggaagcttctcccccctatccttgcccctgcccccccaggatgtgtcctggagatggggggtgacgtaccaggctctggttgggaagtcagggccggagaccagatgggagaggctctgtggacagccgtggccgagggcctgggagggaacctgagcccgcaagcggtctagaagtgggtgccttgtggggaccctagttaggagtgccctgggggcacctggggactgggcagggagaggggacagcagaatgataaccagcctggcggcaaggagggaagccctcaccccatgggcaggcaaatagctgactgctgaccaccctcccctcagccatggacatgcttcatccatcatcggtgtccacgacctcagaacctgagaatgcctcctcggcctggcccccagatgccaccctgggcaacgtgtcggcgggcccaagcccggcagggctggccgtcagtggcgttctgatccccctggtctacctggtggtgtgcgtggtgggcctgctgggtaactcgctggtcatctatgtggtcctgcggcacacggccagcccttcagtcaccaacgtctacatcctcaacctggcgctggccgacgagctcttcatgctggggctgcccttcctggccgcccagaacgccctgtcctactggcccttcggctccctcatgtgccgcctggtcatggcggtggatggcatcaaccagttcaccagcatattctgcctgactgtcatgagcgtggaccgctacctggccgtggtacatcccacccgctcggcccgctggcgcacagctccggtggcccgcacggtcagcgcggctgtgtgggtggcctcagccgtggtggtgctgcccgtggtggtcttctcgggagtgccccgcggcatgagcacctgccacatgcagtggcccgagccggcggcggcctggcgagccggcttcatcatctacacggccgcactgggcttcttcgggccgctgctggtcatctgcctctgctacctgctcatcgtggtgaaggtgcgctcagctgggcgccgggtgtgggcaccctcgtgccagcggcggcggcgctccgaacgcagggtcacgcgcatggtggtggccgtggtggcgctcttcgtgctctgctggatgcccttctacgtgctcaacatcgtcaacgtggtgtgcccactgcccgaggagcctgccttctttgggctctacttcctggtggtggcgctgccctatgccaacagctgtgccaaccccatcctttatggcttcctctcctaccgcttcaagcagggcttccgcagggtcctgctgcggccctcccgccgtgtgcgcagccaggagcccactgtggggcccccggagaagactgaggaggaggatgaggaggaggaggatggggaggagagcagggaggggggcaaggggaaggagatgaacggccgggtcagccagatcacgcagcctggcaccagcgggcaggagcggccgcccagcagagtggccagcaaggagcagcagctcctaccccaagaggcttccactggggagaagtccagcacgatgcgcatcagctacctgtagggcctggggaaagccaggatggcccgaggaagaggcagaagccgtgggtgtgcctagggcctacttcccaaggtgccacaggcccatgatgggatgttgaggggcctggactttgatgctattgctgccaggtcttgctgtgtgaccttgggtaggttgcttctactctctgggccttgttttctcctctgtgactcagggataggagtcatcagcctggatgagctatgtcagatgagaggtttggagggcactgttgctgggctgacctggctgagcaggcaaaaggtgggtgcagactggcctccccccagggatggagtgtcttggggcatcaactagaatcttggccctcagagggataaaccaaggccaggatttcttgggctcagagtcaggaacacaggagctgctgggggctgggctggaaacctaaacagaagaaagcctaacccggtgggaggagtggggcagaaatggtcaggccccagatcagctccctcccctcgactgtgaggccttggaccagctctgctcctctctaggcctcaggcttcacctgggtaaaacccaacaacctctacacccttttggcccaggcagtcaatgctggaggtcctgtgctcctggacgggaagagcaggtgaatttcctgctcatggaagcgaatgaagtccagcttcagggtctctcactgcctgggcttttgcaaggccctgcatctacttttgtacttgtcattttgtattcgttttcttaaagagggacctcgaactgcataagcttaggccacccaaagcctggctctgcccctgctgaggtcagccacccaatccccaaggaagctcatgttgggtcttatggctggagtaggggcccccgggggttcccaggtcttttgagggcttccaggcacctccttgtaggaagggccatccctgttcctctccttgtgacccatattctcccttcctggagaccgagacagggacccagcccatgaggactggcatggaaaggcagagtgtctgaagagcgctgtgaggagaaggaagaggaagggagaagaggaagaggaaggagaaggaagaggaagacaagggggaaaggggaggatgaggagggggaaggagaagtacagatctgtttcctggagccgtctttggcccccctgggctgagctcagtggtagcatctgtgaacctgagttgccgacaacagccccacccaaccagtactgagggaaggacacgatcagggtggaacagccagggtgcaatggcaaatgcacagagtacagacaggcacagggcctgcgtccctgaggggcctcagagtgctgccaagagggctcaggccttaataaagccctagggtggagctggctaccagggacattgggaggactggggagctccctccccatgctctatcatcctggagactacaggtcgggaggcccagggaagacaagaagaggctgaagtgggactgtggagggggaccatggggagcagccaccatccaaggctgggcctagactccctcccagagatggtccctcagagctgtggtgaggctggccctgggagggtgagacccccggtgaaatccttccgcttccccaccccttgcagagggcaggggtcctcagggaaagcacaggaaccagacttttggagacttggatcttcagcacacctcagggtcctgggctggcattggccttccgggcctcaatttccccatcaacaaatggagatgaatcccagcttggctgcctcctgggatctaacgagaaaatgagtcatgtgaggtaacttccaggctcactgcaatgggtacggtggggtgtatcagattataaagtgggggtgccctcctcacccccaggcttggcctatacccccctctccatcaagtggcctctctgtgtctgtcctttggggtgaggacactgtaggccatgagaaatgggcagttggggggtcagaggccaagggttagggaggcagggcttggggagagtgtgggaccatcagaagagaaggaagtttacaaaaccacattttgtgtggagatggaggctggaggcccggccctgggacttggtctggggtttcttgaggaagatctgagggtccaagggaggaaggatgccctggccttctggccttctctggctgatcctgccttcttgctgcctaggacaggagagtaatgtcctagaatggtccctgggaggccagttaggaaaccctttgctgcttctgtctctagctcttgtcaataaagacggtgacacctg

SEQ ID NO: 29464 - DNA, 1780 bp, Homo sapiens
tgagtctgaggcttccatccggggacaatgtcccaccttggagctctccttgttgaacggcttggctgttcacatttatggctgttctgggtgatgtcctaggttctggggttaagaaataaatcattcagggcccctgccttcaagagccagtgttctagcgggtgggagatgggcaaatggagaatgattggggtgcctggcctccctgaactgttagggctgtgcggctcaggacagccactcaccctctctgtgctgtctcctcctgaacagtcctccaaggagtccgcccccagctttcaggcaagcttgtgccaaagataaaccagacagggaggaaaagtccctccttctcaaggatgaactagatcatgcacaggattccagctctaaagaaaagacggcacctcaattgcaggcaaatagctgactgctgaccaccctcccctcagccatggacatgcttcatccatcatcggtgtccacgacctcagaacctgagaatgcctcctcggcctggcccccagatgccaccctgggcaacgtgtcggcgggcccaagcccggcagggctggccgtcagtggcgttctgatccccctggtctacctggtggtgtgcgtggtgggcctgctgggtaactcgctggtcatctatgtggtcctgcggcacacggccagcccttcagtcaccaacgtctacatcctcaacctggcgctggccgacgagctcttcatgctggggctgcccttcctggccgcccagaacgccctgtcctactggcccttcggctccctcatgtgccgcctggtcatggcggtggatggcatcaaccagttcaccagcatattctgcctgactgtcatgagcgtggaccgctacctggccgtggtacatcccacccgctcggcccgctggcgcacagctccggtggcccgcacggtcagcgcggctgtgtgggtggcctcagccgtggtggtgctgcccgtggtggtcttctcgggagtgccccgcggcatgagcacctgccacatgcagtggcccgagccggcggcggcctggcgagccggcttcatcatctacacggccgcactgggcttcttcgggccgctgctggtcatctgcctctgctacctgctcatcgtggtgaaggtgcgctcagctgggcgccgggtgtgggcaccctcgtgccagcggcggcggcgctccgaacgcagggtcacgcgcatggtggtggccgtggtggcgctcttcgtgctctgctggatgcccttctacgtgctcaacatcgtcaacgtggtgtgcccactgcccgaggagcctgccttctttgggctctacttcctggtggtggcgctgccctatgccaacagctgtgccaaccccatcctttatggcttcctctcctaccgcttcaagcagggcttccgcagggtcctgctgcggccctcccgccgtgtgcgcagccaggagcccactgtggggcccccggagaagactgaggaggaggatgaggaggaggaggatggggaggagagcagggaggggggcaaggggaaggagatgaacggccgggtcagccagatcacgcagcctggcaccagcgggcaggagcggccgcccagcagagtggccagcaaggagcagcagctcctaccccaagaggcttccactggggagaagtccagcacgatgcgcatcagctacctgtagggcctggggaaagccaggatggcccgaggaagaggcagaagccgtgggtgtgcctagggcctactt

SEQ ID NO: 29465 - DNA, 1258 bp, Homo sapiens
ccgagctctctggcgcagcgctagctccgccgcgctcagctgccctgcgccggcacccctggtcatgagcgccccctcgacgctgccccccgggggcgaggaagggctggggacggcctggccctctgcagccaatgccagtagcgctccggcggaggcggaggaggcggtggcggggcccggggacgcgcgggcggcgggcatggtcgctatccagtgcatctacgcgctggtgtgcctggtggggctggtgggcaacgccctggtcatcttcgtgatccttcgctacgccaagatgaagacggctaccaacatctacctgctcaacctggccgtagccgacgagctcttcatgctgagcgtgcccttcgtggcctcgtcggccgccctgcgccactggcccttcggctccgtgctgtgccgcgcggtgctcagcgtcgacggcctcaacatgttcaccagcgtcttctgtctcaccgtgctcagcgtggaccgctacgtggccgtggtgcaccctctgcgcgcggcgacctaccggcggcccagcgtggccaagctcatcaacctgggcgtgtggctggcatccctgttggtcactctccccatcgccatcttcgcagacaccagaccggctcgcggcggccaggccgtggcctgcaacctgcagtggccacacccggcctggtcggcagtcttcgtggtctacactttcctgctgggcttcctgctgcccgtgctggccattggcctgtgctacctgctcatcgtgggcaagatgcgcgccgtggccctgcgcgctggctggcagcagcgcaggcgctcggagaagaaaatcaccaggctggtgctgatggtcgtggtcgtctttgtgctctgctggatgcctttctacgtggtgcagctgctgaacctcttcgtgaccagccttgatgccaccgtcaaccacgtgtcccttatccttagctatgccaacagctgcgccaaccccattctctatggcttcctctccgacaacttccgccgattcttccagcgggttctctgcctgcgctgctgcctcctggaaggtgctggaggtgctgaggaggagcccctggactactatgccactgctctcaagagcaaaggtggggcagggtgcatgtgccccccactcccctgccagcaggaagccctgcaaccagaacccggccgcaagcgcatccccctcaccaggaccaccaccttctgaggagcccttcccctacccaccctgcgt

SEQ ID NO: 29466 - DNA, 2674 bp, Homo sapiens
atgcctgcatgtgctggttcagggactcaccaccctggcgtcctcccttcttctcttgcagagcctgacgcaccccagggctgccgccatggagcccctgttcccagcctccacgcccagctggaacgcctcctccccgggggctgcctctggaggcggtgacaacaggacgctggtggggccggcgccctcggcaggggcccgggcggtgctggtgcccgtgctgtacctgctggtgtgtgcggccgggctgggcgggaacacgctggtcatctacgtggtgctgcgcttcgccaagatgaagaccgtcaccaacatctacattctcaacctggcagtggccgacgtcctgtacatgctggggctgcctttcctggccacgcagaacgccgcgtccttctggcccttcggccccgtcctgtgccgcctggtcatgacgctggacggcgtcaaccagttcaccagtgtcttctgcctgacagtcatgagcgtggaccgctacctggcagtggtgcacccgctgagctcggcccgctggcgccgcccgcgtgtggccaagctggcgagcgccgcggcctgggtcctgtctctgtgcatgtcgctgccgctcctggtgttcgcggacgtgcaggagggcggtacctgcaacgccagctggccggagcccgtggggctgtggggcgccgtcttcatcatctacacggccgtgctgggcttcttcgcgccgctgctggtcatctgcctgtgctacctgctcatcgtggtgaaggtgagggcggcgggcgtgcgcgtgggctgcgtgcggcggcgctcggagcggaaggtgacgcgcatggtgttggtggtggtgctggtgtttgcgggatgttggctgcccttcttcaccgtcaacatcgtcaacctggccgtggcgctgccccaggagcccgcctccgccggcctctacttcttcgtggtcatcctctcctacgccaacagctgtgccaaccccgtcctctacggcttcctctctgacaacttccgccagagcttccagaaggttctgtgcctccgcaagggctctggtgccaaggacgctgacgccacggagccgcgtccagacaggatccggcagcagcaggaggccacgccacccgcgcaccgcgccgcagccaacgggcttatgcagaccagcaagctgtgagagtgcaggcggggggtgggcggccccgtgtcacccccaggagcggaggttgcactgcggtgacccccacccatgacctgccagtcaggatgctccccggcggtggtgtgaggacagagctggctgaagccaggctggggtagacacagggcagtaggttccccaccgtgaccgaccatcccctctaaccgtctgccacacagcgggggctcccgggaggtaggggaggtggccagaccggtggggggctccgccatgccgtgcaagtgctcagggccgcctcaccctccatctggccccagcccatgccggccttccctctggggagcgacttttccagaaggccggccaggcgagagggtcttcctgacggcggagctgacctgcccggcccaccagctgcatgtcagctccgagccaccgggtccccgtccaaggctgctctgctaagttaaagacacccgaaagcgcttgactcaggtccccggagtccctggccagggccccagcccctcgcttgccctgcactgtgtggactctggggatgcaggtgtaaggggagtgtggctgggcagcccctggtcagccagggtcacgcctgtcctgggggccccaccctgctgcccgacaccccccatgggaggctgcgggcggcagttgctgtctcagagaggggagtgtgggggcttgggcgctggcctagccaggggcgaggtggggaggcggctggtgcagaggagagctgggggctgaggttggggtgaaggctgcagccctccaggctgctgggggtgcagatggctgtgccgtgctgagattggctctgtctggaggggtccagtgtggggtgcctgagggcactagggagaggtgctcctgctgcaggaggacctgagggtcagggcttggagaggacagggaacctgcggccgtctcttctgctttggggcaggggctctggcccgggagagggaacggggacaggagcagaggacggtcatccaggcgcagcggggagctgctccccaggccacagcagacagcactgctgagaggcagcggccgcgcgggtgacgcaaatggcaggccctgggaatcccgccgcctcccacctagaattgtcctacctcccccaccccaaacaccagcttttcctggcgccccaggcccagaacgtgggcccagagagccttgctggggtctctggggcaccttggccttgctctgaggctggaaggagaaggaccagggtgcggcatcactcggcctcagggacccctctgccctgcccagcactggccccgacccgtgctcccgccgtctgcccagagcaggacctcaacctcctggagggcacagggagcggctgagtgggcacaaatcctggcaggagaaaggcccaggctgaggccaggcctgggaaacatccaagcagtgaggacacgcgtgtttgacaactgctcccctgaataaatgcgaggataaatgttt

SEQ ID NO: 29467 - DNA, 2640 bp, Homo sapiens
ccgggagcccggagccagtgccgcgcggacatcggggctcccccagcctgacgcaccccagggctgccgccatggagcccctgttcccagcctccacgcccagctggaacgcctcctccccgggggctgcctctggaggcggtgacaacaggacgctggtggggccggcgccctcggcaggggcccgggcggtgctggtgcccgtgctgtacctgctggtgtgtgcggccgggctgggcgggaacacgctggtcatctacgtggtgctgcgcttcgccaagatgaagaccgtcaccaacatctacattctcaacctggcagtggccgacgtcctgtacatgctggggctgcctttcctggccacgcagaacgccgcgtccttctggcccttcggccccgtcctgtgccgcctggtcatgacgctggacggcgtcaaccagttcaccagtgtcttctgcctgacagtcatgagcgtggaccgctacctggcagtggtgcacccgctgagctcggcccgctggcgccgcccgcgtgtggccaagctggcgagcgccgcggcctgggtcctgtctctgtgcatgtcgctgccgctcctggtgttcgcggacgtgcaggagggcggtacctgcaacgccagctggccggagcccgtggggctgtggggcgccgtcttcatcatctacacggccgtgctgggcttcttcgcgccgctgctggtcatctgcctgtgctacctgctcatcgtggtgaaggtgagggcggcgggcgtgcgcgtgggctgcgtgcggcggcgctcggagcggaaggtgacgcgcatggtgttggtggtggtgctggtgtttgcgggatgttggctgcccttcttcaccgtcaacatcgtcaacctggccgtggcgctgccccaggagcccgcctccgccggcctctacttcttcgtggtcatcctctcctacgccaacagctgtgccaaccccgtcctctacggcttcctctctgacaacttccgccagagcttccagaaggttctgtgcctccgcaagggctctggtgccaaggacgctgacgccacggagccgcgtccagacaggatccggcagcagcaggaggccacgccacccgcgcaccgcgccgcagccaacgggcttatgcagaccagcaagctgtgagagtgcaggcggggggtgggcggccccgtgtcacccccaggagcggaggttgcactgcggtgacccccacccatgacctgccagtcaggatgctccccggcggtggtgtgaggacagagctggctgaagccaggctggggtagacacagggcagtaggttccccaccgtgaccgaccatcccctctaaccgtctgccacacagcgggggctcccgggaggtaggggaggtggccagaccggtggggggctccgccatgccgtgcaagtgctcagggccgcctcaccctccatctggccccagcccatgccggccttccctctggggagcgacttttccagaaggccggccaggcgagagggtcttcctgacggcggagctgacctgcccggcccaccagctgcatgtcagctccgagccaccgggtccccgtccaaggctgctctgctaagttaaagacacccgaaagcgcttgactcaggtccccggagtccctggccagggccccagcccctcgcttgccctgcactgtgtggactctggggatgcaggtgtaaggggagtgtggctgggcagcccctggtcagccagggtcacgcctgtcctgggggccccaccctgctgcccgacaccccccatgggaggctgcgggcggcagttgctgtctcagagaggggagtgtgggggcttgggcgctggcctagccaggggcgaggtggggaggcggctggtgcagaggagagctgggggctgaggttggggtgaaggctgcagccctccaggctgctgggggtgcagatggctgtgccgtgctgagattggctctgtctggaggggtccagtgtggggtgcctgagggcactagggagaggtgctcctgctgcaggaggacctgagggtcagggcttggagaggacagggaacctgcggccgtctcttctgctttggggcaggggctctggcccgggagagggaacggggacaggagcagaggacggtcatccaggcgcagcggggagctgctccccaggccacagcagacagcactgctgagaggcagcggccgcgcgggtgacgcaaatggcaggccctgggaatcccgccgcctcccacctagaattgtcctacctcccccaccccaaacaccagcttttcctggcgccccaggcccagaacgtgggcccagagagccttgctggggtctctggggcaccttggccttgctctgaggctggaaggagaaggaccagggtgcggcatcactcggcctcagggacccctctgccctgcccagcactggccccgacccgtgctcccgccgtctgcccagagcaggacctcaacctcctggagggcacagggagcggctgagtgggcacaaatcctggcaggagaaaggcccaggctgaggccaggcctgggaaacatccaagcagtgaggacacgcgtgtttgacaactgctcccctgaataaa

SEQ ID NO: 29468 - DNA, 1085 bp, Homo sapiens
atggagcccctgttcccagcctccacgcccagctggaacgcctcctccccgggggctgcctctggaggcggtgacaacaggacgctggtggggccggcgccctcggcaggggcccgggcggtgctggtgcccgtgctgtacctgctggtgtgtgcggccgggctgggcgggaacacgctggtcatctacgtggtgctgcgcttcgccaagatgaagaccgtcaccaacatctacattctcaacctggcagtggccgacgtcctgtacatgctggggctgcctttcctggccacgcagaacgccgcgtccttctggcccttcggccccgtcctgtgccgcctggtcatgacgctggacggcgtcaaccagttcaccagtgtcttctgcctgacagtcatgagcgtggaccgctacctggcagtggtgcacccgctgagctcggcccgctggcgccgcccgcgtgtggccaagctggcgagcgccgcggcctgggtcctgtctctgtgcatgtcgctgccgctcctggtgttcgcggacgtgcaggagggcggtacctgcaacgccagctggccggagcccgtggggctgtggggcgccgtcttcatcatctacacggccgtgctgggcttcttcgcgccgctgctgagaggcagcggccgcgcgggtgacgcaaatggcaggccctgggaatcccgccgcctcccacctagaattgtcctacctcccccaccccaaacaccagcttttcctggcgccccaggcccagaacgtgggcccagagagccttgctggggtctctggggcaccttggccttgctctgaggctggaaggagaaggaccagggtgcggcatcactcggcctcagggacccctctgccctgcccagcactggccccgacccgtgctcccgccgtctgcccagagcaggacctcaacctcctggagggcacagggagcggctgagtgggcacaaatcctggcaggagaaaggcccaggctgaggccaggcctgggaaacatccaagcagtgaggacacgcgtgtttgacaactgctcccctgaataaatgcgaggataaatgttt

SEQ ID NO: 29469 - DNA, 8492 bp, Homo sapiens
ggagcctggaggactagcgaggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacaaaaacaaaaagaagaaaaagaagaaagaaaaggaaaaaaaatataaaagacagccagaagaatctgagtcaaagacgaaatctcatgatgatgggaacatagatttagaatctgattcctttttaaagtttgattctgaaccttcagctgtggcgctggagcttcctacaagagcatttggcccatctgagaccaatgaatcccctgcagttgtgctagaacctcctgtagtatcaatggaggtatcagagccacacatcttagaaactctgaagccagctacaaaaactgcagaactgtcagttgtatctacatcagtaatctcagagcagtcagagcagtctgtggcagtaatgccagaaccatccatgacaaagattctggattcctttgcagcagcaccagtgcctactacaacactggtgttgaagtcatctgagccagttgtaacaatgtcagtggagtatcagatgaagtctgtgctgaaatctgtggagagcacatctccagagccatcaaagatcatgttggtagagcccccagtagcaaaagtgttagagccttcagaaacccttgtggtatcatcagagacacctactgaggtgtaccctgagccaagcacatcaacaacaatggattttccagagtcatctgcaattgaagcgctaagattgccagagcagcctgtagacgtaccatcggagattgcagattcatccatgacaagaccgcaggagttgccggagctgcctaagaccacagcgttggagctgcaggagtcgtcggtggcctcagcgatggagttgccggggccacctgcgacctccatgccggagttgcaggggccccctgtgactccagtgctggagttacctgggccctctgctaccccggtgccagagttgccagggcccctttctaccccagtgcctgagttgccagggccccctgcgacagcagtgcctgagttgccagggccctctgtgacaccagtgccacagttgtcgcaggaattgccagggcttccagcaccatccatggggttggagccaccacaggaggtaccagagccacctgtgatggcacaggagttgccagggctgcctttggtgacagcagcagtagagttgccagagcagcctgcggtaacagtagcaatggagttgaccgaacaacctgtgacgacgacagagttggagcagcctgtggggatgacaacggtggaacatcctgggcatcctgaggtgacaacggcaacagggttgctggggcagcctgaggcaacgatggtgctggagttgccaggacagccagtggcaacgacagcgctggagttgccggggcagccttcggtgactggggtgccagagttgccagggctgccttcggcaactagggcactggagttgtcggggcagcctgtggcaactggggcactagagttgcctgggccgctcatggcagctggggcactggagttctcggggcagtctggggcagctggagcactggagcttttggggcagcctctggcaacaggggtgctggagttgccagggcagcctggggcgccagagttgcctgggcagcctgtggcaactgtggcgctggagatctctgttcagtctgtggtgacaacatcggagctgtcaacgatgaccgtgtcgcagtccctggaggtgccctcgacgacagcgctggaatcctataatacggtagcacaggagctgcctactacattagtgggggagacttctgtaacagtaggagtggatcccttgatggccccagaatcccatatattagcttctaacaccatggagacccatatattagcatccaacaccatggactcccaaatgctagcgtccaacaccatggactcccagatgctagcatccaacaccatggactcccagatgttagcgtctagcaccatggactcccagatgttagcaactagctccatggactcccagatgttagcaactagctccatggactcccagatgttagcaactagcactatggactcccagatgttagcaaccagttccatggactcccagatgttagcaaccagctccatggactcccagatgttagcaaccagctccatggactcccagatgttagcaaccagctccatggactcccagatgttagcaaccagcaccatggattctcagatgttagcaaccagcaccatggactcccagatgttagcaactagctcaatggattcccagatgttagcatctggcactatggactctcaaatgttagcttctggcaccatggatgctcagatgttagcgtctggtaccatggatgcccagatgttagcgtctagtacccaagattctgctatgttgggttcaaaatctcctgatccctataggttagctcaggatccttacaggttagctcaggatccctataggttgggccatgacccctatagattaggtcatgatgcttacaggttaggacaagacccttatagattaggccatgatccctacagactaactcctgatccctataggatgtcacctagaccctacaggatagcacccaggtcctatagaatagcacccaggccatataggttagcacctagacccctgatgttagcatctagacgttctatgatgatgtcctatgctgcagaacgttccatgatgtcatcttacgaacgctctatgatgtcttatgagcggtctatgatgtcccctatggctgaacgctctatgatgtcagcctacgagcgctctatgatgtcagcctacgagcgctctatgatgtcccctatggctgagcgctctatgatgtcagcttatgaacgctccatgatgtcagcttatgaacgctccatgatgtccccaatggctgatcgatctatgatgtccatgggtgctgaccggtctatgatgtcgtcatactctgctgctgaccggtctatgatgtcatcgtactctgcagctgaccgatctatgatgtcatcttatactgctgatcgttcaatgatgtctatggctgctgattcttacaccgattcttacactgacacatatacagaggcatatatggtgccacctttgcctcctgaagagcccccaacaatgccaccgttgccacctgaggagccaccaatgacaccaccattgcctcctgaggaaccaccagagggtccagcattgcccactgagcagtcagcattaacagctgaaaatacttggcctacagaggtgccatcatcaccatctgaagagtctgtatcgcagcctgagcctcctgtgagtcaaagtgagatttcggagccttcagcagtgcctactgattattcagtgtcagcatcagatccctcagttttagtatcagaggctgctgtgactgttccagaaccaccaccagagccagaatcttcaattacgttaacacctgtagagtctgcagtagtagcagaagaacatgaagttgttccagagagaccagtgacttgtatggtatctgaaactcccgccatgtcagctgaaccaactgtgttagcatcagagcctcctgttatgtcagagacagcagaaacatttgattccatgagagcctcaggacatgttgcctcagaagtatctacatccttgttggttccagcagtaactactccagtgctggcagagagcattctggagccgccagccatggctgccccagagtcttcagctatggctgtcctggagtcttcggctgtgaccgtcctggagtcttcgactgtgactgtcctggagtcttcgactgtaactgtcctggagccttcggttgtgactgtcccggagcctcctgttgtggctgagccagactatgttaccattcctgtgccagttgtttctgcgctggagccttctgtgcctgttctggaaccagcggtgtcagtccttcaaccttctatgattgtttcagaaccatctgtttctgtccaggaatcgactgtgacagtttcagagcctgctgtcacagtctcagagcagactcaagtaataccaactgaggtggctatagagtccacaccaatgatactggaatctagtatcatgtcatcacatgttatgaaaggaattaatctatcctctggtgatcaaaatcttgctccagagattggcatgcaggagattgcattgcattcaggtgaagaaccacatgctgaggaacacctgaaaggtgacttttacgaaagtgaacatggtataaatatagaccttaatataaataatcatttaattgctaaagagatggaacataatacagtgtgtgctgctggtactagtcctgttggggaaattggtgaagagaaaattttgcccaccagtgagactaaacagcgcacagtattggatacctaccctggtgttagtgaagctgatgcaggagaaactctatcttctactggtccttttgctctggaacctgatgcaacaggaactagtaagggtattgaatttaccacagcatctactctcagtttagttaataaatatgatgttgatttatctttaactactcaagatactgaacatgacatggtaatttccaccagtcctagtggtggtagtgaagctgacattgaagggcctttgcctgctaaagatattcatcttgatttaccatctaataataaccttgttagtaaggatacagaagaaccattacctgtaaaagagagtgaccagacattagcagctctgctcagccctaaagaaagtagtggaggagaaaaagaagtacctccccctcctaaagagacactgcctgattcaggattttctgccaatattgaggatattaatgaagcagatttagtgagaccgttacttcctaaggacatggaacgtcttacaagccttagagctggcattgaaggacctttacttgcaagtgatgttggacgtgacagatctgctgccagcccggttgtaagtagtatgccagaaagagcttcagagtcttcttcagaggaaaaagatgattatgaaatttttgtaaaagttaaggacactcacgaaaaaagcaagaaaaataagaaccgtgataagggggagaaagagaagaaaagagactcttcattaagatctcgaagtaagcgttccaaatcttctgaacacaaatcacgcaagcgtaccagtgaatctcgttctagggcaagaaagagatcatctaagtccaagtctcatcgctctcagacacgttcacggtcacgttcaagacgcaggaggagaagcagcagatcaagatcaaagtctagaggaagaagatctgtatcaaaagagaagcgcaaaagatctccaaagcacagatccaagtctagggaaagaaaaagaaaaagatcaagctccagggataaccgaaagacagttagagctcgaagtcgaaccccaagtcgtcggagtcggagtcatactccaagtcgtcgacgaaggtctagatctgtgggtagaagaaggagctttagcatttccccaagccgccgcagccgcacccccagccgccgcagccgcacccccagccgccgcagccgcacccccagccgccgcagccgcacccccagccgccggagccgcacccctagccgtcggagccgcaccccaagccgccggagaagatcaaggtctgtggtaagaagacgaagcttcagtatctcaccagtcagattaaggcgatcaagaacacccttaagaagaaggtttagcagatctcccatccgtcgtaaaagatccaggtcttctgaacgaggcagatcacccaaacgtctgacagatttggataaggctcaattacttgaaatagccaaagctaatgcagctgccatgtgtgctaaggctggtgtccctttaccaccaaacctaaagcctgcacctccacctactatagaagagaaagttgctaaaaagtcaggaggagctactatagaagaactaactgagaaatgtaaacagatcgcacagagtaaagaagatgatgatgtaatagtgaataaacctcatgtttcggatgaagaggaagaagaacctcctttttatcatcatccctttaaactcagtgaacccaaacctatttttttcaatctgaatattgctgcagcaaaaccaactccaccaaaaagccaggtaacattaacaaaagaattccctgtatcatctggatctcaacatcggaaaaaagaagcggatagtgtttatggagaatgggttcctgtggagaaaaatggtgaagaaaacaaagatgatgataatgttttcagcagcaatttgccctcagagcctgtggacatctctacagcaatgagtgaacgggcacttgctcagaaaagactcagtgagaatgcatttgatcttgaagccatgagcatgttaaatagagctcaggaaaggattgatgcctgggctcagctgaactctattcctggccagttcacaggaagtacaggagtacaggttttgacacaagaacagttggccaatactggtgcccaagcctggattaaaaagggccaaatccttgtagctgtcttcttgccccggtcagtgccagccgtactattcacaacactgctgctaccgaggcctaggatcagttcttaagagcagccccggtaactggaggaatgggagccgttttgatgagaaaaatgggctggagagaaggagaaggattaggaaaaaacaaagaaggcaataaggaacccatcctagttgattttaagacagaccgaaaaggtcttgttgcagtaggagaaagagcacaaaagaggtctgggaacttctctgctgcaatgaaagatctgtcaggcaaacatcctgtgtctgctttgatggagatctgtaataaaagaaggtggcaaccacctgaatttctattggtccatgatagtggccctgatcatcgcaaacattttctctttagggtattgagaaatggagcccttaccagacccaattgtatgtttttcttgaataggtattgataaatggaagcgcttaccagcccagctttgccagccctaataagaagcatgctaaagccacagcagctactgtggttcttcaagcaatgggccttgtaccaaaggacctcatggctaatgccacttgcttcaggagtgcctcacgtagatagattgaggttttataataatcatttcagaattttactctgcatcacaatgtatttcctctttaatgttgtaaatatttggcaatttaagacattgtgtaaaaagcaatctgtaaaaacatctccaggctttgatttttgtaccatggaaattgtatttaaccatacagggttttggtatgtttatattgtttaccttagtgatgtatttgtttaagtggctaacatccaaacgactgtttgaaggcatcagagtaatcttcagtgtggaatgttaaataacgcttttatactgtattttgtactatgatgtaactccccttccttatggctaggctactgtaacacttgcctgtaatcagtgaagggctgtgcaccttgtactatttcacaatgggttctgctggacagataatgggccagtgttattgaggtgatcaagatctgttccacagggctaatgccaccatctcccctcaaaattttgtagaggttctaaaaagaaagtggtatgttgtgtgatgatcagcactaagtcctgcattcctgttaaagccacttgggtcataagaagggagtaaaaaatgaagtctgactagaattctattgcagaggccagtacatttagtatggcattgagttgtgatatagttttactttgatgtgcattttgaatttcagctacacctagatagacgtaaaatgataattaaaatgctgtaaccaacttatctaataaaattggcaaccagccactattttgttgactatgagaaagttaaaagtttatgttaatttttagggtctgatagaatatttcatgtgtattacagtggtattcatatgctatgtctctaaactttattttcaaaagcttaaggcccaaatacaaacttctctggaataaacgtggtgttttattttctgggttat

SEQ ID NO: 29470 - DNA, 7477 bp, Homo sapiens
ggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacaaaaacaaaaagaagaaaaagaagaaagaaaaggaaaaaaaatataaaagacagccagaagaatctgagtcaaagacgaaatctcatgatgatgggaacatagatttagaatctgattcctttttaaagtttgattctgaaccttcagctgtggcgctggagcttcctacaagagcatttggcccatctgagaccaatgaatcccctgcagttgtgctagaacctcctgtagtatcaatggaggtatcagagccacacatcttagaaactctgaagccagctacaaaaactgcagaactgtcagttgtatctacatcagtaatctcagagcagtcagagcagtctgtggcagtaatgccagaaccatccatgacaaagattctggattcctttgcagcagcaccagtgcctactacaacactggtgttgaagtcatctgagccagttgtaacaatgtcagtggagtatcagatgaagtctgtgctgaaatctgtggagagcacatctccagagccatcaaagatcatgttggtagagcccccagtagcaaaagtgttagagccttcagaaacccttgtggtatcatcagagacacctactgaggtgtaccctgagccaagcacatcaacaacaatggattttccagagtcatctgcaattgaagcgctaagattgccagagcagcctgtagacgtaccatcggagattgcagattcatccatgacaagaccgcaggagttgccggagctgcctaagaccacagcgttggagctgcaggagtcgtcggtggcctcagcgatggagttgccggggccacctgcgacctccatgccggagttgcaggggccccctgtgactccagtgctggagttacctgggccctctgctaccccggtgccagagttgccagggcccctttctaccccagtgcctgagttgccagggccccctgcgacagcagtgcctgagttgccagggccctctgtgacaccagtgccacagttgtcgcaggaattgccagggcttccagcaccatccatggggttggagccaccacaggaggtaccagagccacctgtgatggcacaggagttgccagggctgcctttggtgacagcagcagtagagttgccagagcagcctgcggtaacagtagcaatggagttgaccgaacaacctgtgacgacgacagagttggagcagcctgtggggatgacaacggtggaacatcctgggcatcctgaggtgacaacggcaacagggttgctggggcagcctgaggcaacgatggtgctggagttgccaggacagccagtggcaacgacagcgctggagttgccggggcagccttcggtgactggggtgccagagttgccagggctgccttcggcaactagggcactggagttgtcggggcagcctgtggcaactggggcactagagttgcctgggccgctcatggcagctggggcactggagttctcggggcagtctggggcagctggagcactggagcttttggggcagcctctggcaacaggggtgctggagttgccagggcagcctggggcgccagagttgcctgggcagcctgtggcaactgtggcgctggagatctctgttcagtctgtggtgacaacatcggagctgtcaacgatgaccgtgtcgcagtccctggaggtgccctcgacgacagcgctggaatcctataatacggtagcacaggagctgcctactacattagtgggggagacttctgtaacagtaggagtggatcccttgatggccccagaatcccatatattagcttctaacaccatggagacccatatattagcatccaacaccatggactcccaaatgctagcgtccaacaccatggactcccagatgctagcatccaacaccatggactcccagatgttagcgtctagcaccatggactcccagatgttagcaactagctccatggactcccagatgttagcaactagctccatggactcccagatgttagcaactagcactatggactcccagatgttagcaaccagttccatggactcccagatgttagcaaccagctccatggactcccagatgttagcaaccagctccatggactcccagatgttagcaaccagctccatggactcccagatgttagcaaccagcaccatggattctcagatgttagcaaccagcaccatggactcccagatgttagcaactagctcaatggattcccagatgttagcatctggcactatggactctcaaatgttagcttctggcaccatggatgctcagatgttagcgtctggtaccatggatgcccagatgttagcgtctagtacccaagattctgctatgttgggttcaaaatctcctgatccctataggttagctcaggatccttacaggttagctcaggatccctataggttgggccatgacccctatagattaggtcatgatgcttacaggttaggacaagacccttatagattaggccatgatccctacagactaactcctgatccctataggatgtcacctagaccctacaggatagcacccaggtcctatagaatagcacccaggccatataggttagcacctagacccctgatgttagcatctagacgttctatgatgatgtcctatgctgcagaacgttccatgatgtcatcttacgaacgctctatgatgtcttatgagcggtctatgatgtcccctatggctgaacgctctatgatgtcagcctacgagcgctctatgatgtcagcctacgagcgctctatgatgtcccctatggctgagcgctctatgatgtcagcttatgaacgctccatgatgtcagcttatgaacgctccatgatgtccccaatggctgatcgatctatgatgtccatgggtgctgaccggtctatgatgtcgtcatactctgctgctgaccggtctatgatgtcatcgtactctgcagctgaccgatctatgatgtcatcttatactgctgatcgttcaatgatgtctatggctgctgattcttacaccgattcttacactgacacatatacagaggcatatatggtgccacctttgcctcctgaagagcccccaacaatgccaccgttgccacctgaggagccaccaatgacaccaccattgcctcctgaggaaccaccagagggtccagcattgcccactgagcagtcagcattaacagctgaaaatacttggcctacagaggtgccatcatcaccatctgaagagtctgtatcgcagcctgagcctcctgtgagtcaaagtgagatttcggagccttcagcagtgcctactgattattcagtgtcagcatcagatccctcagttttagtatcagaggctgctgtgactgttccagaaccaccaccagagccagaatcttcaattacgttaacacctgtagagtctgcagtagtagcagaagaacatgaagttgttccagagagaccagtgacttgtatggtatctgaaactcccgccatgtcagctgaaccaactgtgttagcatcagagcctcctgttatgtcagagacagcagaaacatttgattccatgagagcctcaggacatgttgcctcagaagtatctacatccttgttggttccagcagtaactactccagtgctggcagagagcattctggagccgccagccatggctgccccagagtcttcagctatggctgtcctggagtcttcggctgtgaccgtcctggagtcttcgactgtgactgtcctggagtcttcgactgtaactgtcctggagccttcggttgtgactgtcccggagcctcctgttgtggctgagccagactatgttaccattcctgtgccagttgtttctgcgctggagccttctgtgcctgttctggaaccagcggtgtcagtccttcaaccttctatgattgtttcagaaccatctgtttctgtccaggaatcgactgtgacagtttcagagcctgctgtcacagtctcagagcagactcaagtaataccaactgaggtggctatagagtccacaccaatgatactggaatctagtatcatgtcatcacatgttatgaaaggaattaatctatcctctggtgatcaaaatcttgctccagagattggcatgcaggagattgcattgcattcaggtgaagaaccacatgctgaggaacacctgaaaggtgacttttacgaaagtgaacatggtataaatatagaccttaatataaataatcatttaattgctaaagagatggaacataatacagtgtgtgctgctggtactagtcctgttggggaaattggtgaagagaaaattttgcccaccagtgagactaaacagcgcacagtattggatacctaccctggtgttagtgaagctgatgcaggagaaactctatcttctactggtccttttgctctggaacctgatgcaacaggaactagtaagggtattgaatttaccacagcatctactctcagtttagttaataaatatgatgttgatttatctttaactactcaagatactgaacatgacatggtaatttccaccagtcctagtggtggtagtgaagctgacattgaagggcctttgcctgctaaagatattcatcttgatttaccatctaataataaccttgttagtaaggatacagaagaaccattacctgtaaaagagagtgaccagacattagcagctctgctcagccctaaagaaagtagtggaggagaaaaagaagtacctccccctcctaaagagacactgcctgattcaggattttctgccaatattgaggatattaatgaagcagatttagtgagaccgttacttcctaaggacatggaacgtcttacaagccttagagctggcattgaaggacctttacttgcaagtgatgttggacgtgacagatctgctgccagcccggttgtaagtagtatgccagaaagagcttcagagtcttcttcagaggaaaaagatgattatgaaatttttgtaaaagttaaggacactcacgaaaaaagcaagaaaaataagaaccgtgataagggggagaaagagaagaaaagagactcttcattaagatctcgaagtaagcgttccaaatcttctgaacacaaatcacgcaagcgtaccagtgaatctcgttctagggcaagaaagagatcatctaagtccaagtctcatcgctctcagacacgttcacggtcacgttcaagacgcaggaggagaagcagcagatcaagatcaaagtctagaggaagaagatctgtatcaaaagagaagcgcaaaagatctccaaagcacagatccaagtctagggaaagaaaaagaaaaagatcaagctccagggataaccgaaagacagttagagctcgaagtcgaaccccaagtcgtcggagtcggagtcatactccaagtcgtcgacgaaggtctagatctgtgggtagaagaaggagctttagcatttccccaagccgccgcagccgcacccccagccgccgcagccgcacccccagccgccgcagccgcacccccagccgccgcagccgcacccccagccgccggagccgcacccctagccgtcggagccgcaccccaagccgccggagaagatcaaggtctgtggtaagaagacgaagcttcagtatctcaccagtcagattaaggcgatcaagaacacccttaagaagaaggtttagcagatctcccatccgtcgtaaaagatccaggtcttctgaacgaggcagatcacccaaacgtctgacagatttggataaggctcaattacttgaaatagccaaagctaatgcagctgccatgtgtgctaaggctggtgtccctttaccaccaaacctaaagcctgcacctccacctactatagaagagaaagttgctaaaaagtcaggaggagctactatagaagaactaactgagaaatgtaaacagatcgcacagagtaaagaagatgatgatgtaatagtgaataaacctcatgtttcggatgaagaggaagaagaacctcctttttatcatcatccctttaaactcagtgaacccaaacctatttttttcaatctgaatattgctgcagcaaaaccaactccaccaaaaagccaggtaacattaacaaaagaattccctgtatcatctggatctcaacatcggaaaaaagaagcggatagtgtttatggagaatgggttcctgtggagaaaaatggtgaagaaaacaaagatgatgataatgttttcagcagcaatttgccctcagagggccgggttaaacggcagggccgggttagacgacagatgaaacaacccgcagcttctcatttgacagtaactcgatgcaattcactttgtggaaccaagccacaaagtgaaaagcatcgaattgcagagaacagtgttatcacatccctacccaacattgggccctccctgcacttgtgggaaggtagtccaaggtacaactatttagcttcccgatttgcttcaaggctctatagctctagattttggtggtagcaaatttatcgggtggagggattgatcggagagggcagatcctcaggttcaacacaagaactggattggaaaaggtcattgtaggttgatgtgagcatcttgggtacatagcccattgcccttaatgatggtttcttactgtttctctgggttgtttgtcagatagcctttaattttaattatttttccttccctttgctaccttggcccttttaaattcttgtgtttaacctaatgctcagccttggtactccattcccttctccttcccctctttgctactattaaaagtcggagaagtggaattcaaacgttgaaatttccacggggctatagttgtatcttaataatgccaagtgtcaaaacaaccccattaaaatgccgcctgattaaataatgtgctgctaaatatagtgcacatgaaaacagcaagactgtatatatatgtaaatatatatatatatctgtatctttgtatgtatctctgtatctgtacctttgctgtatcttttaataaacagtttacttttatttaa

SEQ ID NO: 29471 - DNA, 8813 bp, Homo sapiens
ctcccggatgcatatccctgtcgaaactgaacttggcgccacctgagagcgcctgaaagccgtgtgttaaacaccgggttgcccttcttgctcttcttcctcttcgcctttaatctcaggcacttagcaagcctgttaaggctcccaaacactgctggggactgacaacttatgcggacacggtcgcctcaagagagacggctcctgtaatggcgcctgcgtcagacactaacatggcggacatagtcgtgcgcggcgcaaacgtcagcacctctaccccagccgctcagaaacagcagaggagagcagggccgtgctcactgattggtccctcggtggagcgggccggaccgggcattccctttggagccaatcaggaaggcgagagaccgaattggcccgtgcgcctcctcccgaggcatgctgggagcctggaggactagcgaggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacaaaaacaaaaagaagaaaaagaagaaagaaaaggaaaaaaaatataaaagacagccagaagaatctgagtcaaagacgaaatctcatgatgatgggaacatagatttagaatctgattcctttttaaagtttgattctgaaccttcagctgtggcgctggagcttcctacaagagcatttggcccatctgagaccaatgaatcccctgcagttgtgctagaacctcctgtagtatcaatggaggtatcagagccacacatcttagaaactctgaagccagctacaaaaactgcagaactgtcagttgtatctacatcagtaatctcagagcagtcagagcagtctgtggcagtaatgccagaaccatccatgacaaagattctggattcctttgcagcagcaccagtgcctactacaacactggtgttgaagtcatctgagccagttgtaacaatgtcagtggagtatcagatgaagtctgtgctgaaatctgtggagagcacatctccagagccatcaaagatcatgttggtagagcccccagtagcaaaagtgttagagccttcagaaacccttgtggtatcatcagagacacctactgaggtgtaccctgagccaagcacatcaacaacaatggattttccagagtcatctgcaattgaagcgctaagattgccagagcagcctgtagacgtaccatcggagattgcagattcatccatgacaagaccgcaggagttgccggagctgcctaagaccacagcgttggagctgcaggagtcgtcggtggcctcagcgatggagttgccggggccacctgcgacctccatgccggagttgcaggggccccctgtgactccagtgctggagttacctgggccctctgctaccccggtgccagagttgccagggcccctttctaccccagtgcctgagttgccagggccccctgcgacagcagtgcctgagttgccagggccctctgtgacaccagtgccacagttgtcgcaggaattgccagggcttccagcaccatccatggggttggagccaccacaggaggtaccagagccacctgtgatggcacaggagttgccagggctgcctttggtgacagcagcagtagagttgccagagcagcctgcggtaacagtagcaatggagttgaccgaacaacctgtgacgacgacagagttggagcagcctgtggggatgacaacggtggaacatcctgggcatcctgaggtgacaacggcaacagggttgctggggcagcctgaggcaacgatggtgctggagttgccaggacagccagtggcaacgacagcgctggagttgccggggcagccttcggtgactggggtgccagagttgccagggctgccttcggcaactagggcactggagttgtcggggcagcctgtggcaactggggcactagagttgcctgggccgctcatggcagctggggcactggagttctcggggcagtctggggcagctggagcactggagcttttggggcagcctctggcaacaggggtgctggagttgccagggcagcctggggcgccagagttgcctgggcagcctgtggcaactgtggcgctggagatctctgttcagtctgtggtgacaacatcggagctgtcaacgatgaccgtgtcgcagtccctggaggtgccctcgacgacagcgctggaatcctataatacggtagcacaggagctgcctactacattagtgggggagacttctgtaacagtaggagtggatcccttgatggccccagaatcccatatattagcttctaacaccatggagacccatatattagcatccaacaccatggactcccaaatgctagcgtccaacaccatggactcccagatgctagcatccaacaccatggactcccagatgttagcgtctagcaccatggactcccagatgttagcaactagctccatggactcccagatgttagcaactagctccatggactcccagatgttagcaactagcactatggactcccagatgttagcaaccagttccatggactcccagatgttagcaaccagctccatggactcccagatgttagcaaccagctccatggactcccagatgttagcaaccagctccatggactcccagatgttagcaaccagcaccatggattctcagatgttagcaaccagcaccatggactcccagatgttagcaactagctcaatggattcccagatgttagcatctggcactatggactctcaaatgttagcttctggcaccatggatgctcagatgttagcgtctggtaccatggatgcccagatgttagcgtctagtacccaagattctgctatgttgggttcaaaatctcctgatccctataggttagctcaggatccttacaggttagctcaggatccctataggttgggccatgacccctatagattaggtcatgatgcttacaggttaggacaagacccttatagattaggccatgatccctacagactaactcctgatccctataggatgtcacctagaccctacaggatagcacccaggtcctatagaatagcacccaggccatataggttagcacctagacccctgatgttagcatctagacgttctatgatgatgtcctatgctgcagaacgttccatgatgtcatcttacgaacgctctatgatgtcttatgagcggtctatgatgtcccctatggctgaacgctctatgatgtcagcctacgagcgctctatgatgtcagcctacgagcgctctatgatgtcccctatggctgagcgctctatgatgtcagcttatgaacgctccatgatgtcagcttatgaacgctccatgatgtccccaatggctgatcgatctatgatgtccatgggtgctgaccggtctatgatgtcgtcatactctgctgctgaccggtctatgatgtcatcgtactctgcagctgaccgatctatgatgtcatcttatactgctgatcgttcaatgatgtctatggctgctgattcttacaccgattcttacactgacacatatacagaggcatatatggtgccacctttgcctcctgaagagcccccaacaatgccaccgttgccacctgaggagccaccaatgacaccaccattgcctcctgaggaaccaccagagggtccagcattgcccactgagcagtcagcattaacagctgaaaatacttggcctacagaggtgccatcatcaccatctgaagagtctgtatcgcagcctgagcctcctgtgagtcaaagtgagatttcggagccttcagcagtgcctactgattattcagtgtcagcatcagatccctcagttttagtatcagaggctgctgtgactgttccagaaccaccaccagagccagaatcttcaattacgttaacacctgtagagtctgcagtagtagcagaagaacatgaagttgttccagagagaccagtgacttgtatggtatctgaaactcccgccatgtcagctgaaccaactgtgttagcatcagagcctcctgttatgtcagagacagcagaaacatttgattccatgagagcctcaggacatgttgcctcagaagtatctacatccttgttggttccagcagtaactactccagtgctggcagagagcattctggagccgccagccatggctgccccagagtcttcagctatggctgtcctggagtcttcggctgtgaccgtcctggagtcttcgactgtgactgtcctggagtcttcgactgtaactgtcctggagccttcggttgtgactgtcccggagcctcctgttgtggctgagccagactatgttaccattcctgtgccagttgtttctgcgctggagccttctgtgcctgttctggaaccagcggtgtcagtccttcaaccttctatgattgtttcagaaccatctgtttctgtccaggaatcgactgtgacagtttcagagcctgctgtcacagtctcagagcagactcaagtaataccaactgaggtggctatagagtccacaccaatgatactggaatctagtatcatgtcatcacatgttatgaaaggaattaatctatcctctggtgatcaaaatcttgctccagagattggcatgcaggagattgcattgcattcaggtgaagaaccacatgctgaggaacacctgaaaggtgacttttacgaaagtgaacatggtataaatatagaccttaatataaataatcatttaattgctaaagagatggaacataatacagtgtgtgctgctggtactagtcctgttggggaaattggtgaagagaaaattttgcccaccagtgagactaaacagcgcacagtattggatacctaccctggtgttagtgaagctgatgcaggagaaactctatcttctactggtccttttgctctggaacctgatgcaacaggaactagtaagggtattgaatttaccacagcatctactctcagtttagttaataaatatgatgttgatttatctttaactactcaagatactgaacatgacatggtaatttccaccagtcctagtggtggtagtgaagctgacattgaagggcctttgcctgctaaagatattcatcttgatttaccatctaataataaccttgttagtaaggatacagaagaaccattacctgtaaaagagagtgaccagacattagcagctctgctcagccctaaagaaagtagtggaggagaaaaagaagtacctccccctcctaaagagacactgcctgattcaggattttctgccaatattgaggatattaatgaagcagatttagtgagaccgttacttcctaaggacatggaacgtcttacaagccttagagctggcattgaaggacctttacttgcaagtgatgttggacgtgacagatctgctgccagcccggttgtaagtagtatgccagaaagagcttcagagtcttcttcagaggaaaaagatgattatgaaatttttgtaaaagttaaggacactcacgaaaaaagcaagaaaaataagaaccgtgataagggggagaaagagaagaaaagagactcttcattaagatctcgaagtaagcgttccaaatcttctgaacacaaatcacgcaagcgtaccagtgaatctcgttctagggcaagaaagagatcatctaagtccaagtctcatcgctctcagacacgttcacggtcacgttcaagacgcaggaggagaagcagcagatcaagatcaaagtctagaggaagaagatctgtatcaaaagagaagcgcaaaagatctccaaagcacagatccaagtctagggaaagaaaaagaaaaagatcaagctccagggataaccgaaagacagttagagctcgaagtcgaaccccaagtcgtcggagtcggagtcatactccaagtcgtcgacgaaggtctagatctgtgggtagaagaaggagctttagcatttccccaagccgccgcagccgcacccccagccgccgcagccgcacccccagccgccgcagccgcacccccagccgccgcagccgcacccccagccgccggagccgcacccctagccgtcggagccgcaccccaagccgccggagaagatcaaggtctgtggtaagaagacgaagcttcagtatctcaccagtcagattaaggcgatcaagaacacccttaagaagaaggtttagcagatctcccatccgtcgtaaaagatccaggtcttctgaacgaggcagatcacccaaacgtctgacagatttggataaggctcaattacttgaaatagccaaagctaatgcagctgccatgtgtgctaaggctggtgtccctttaccaccaaacctaaagcctgcacctccacctactatagaagagaaagttgctaaaaagtcaggaggagctactatagaagaactaactgagaaatgtaaacagatcgcacagagtaaagaagatgatgatgtaatagtgaataaacctcatgtttcggatgaagaggaagaagaacctcctttttatcatcatccctttaaactcagtgaacccaaacctatttttttcaatctgaatattgctgcagcaaaaccaactccaccaaaaagccaggtaacattaacaaaagaattccctgtatcatctggatctcaacatcggaaaaaagaagcggatagtgtttatggagaatgggttcctgtggagaaaaatggtgaagaaaacaaagatgatgataatgttttcagcagcaatttgccctcagagcctgtggacatctctacagcaatgagtgaacgggcacttgctcagaaaagactcagtgagaatgcatttgatcttgaagccatgagcatgttaaatagagctcaggaaaggattgatgcctgggctcagctgaactctattcctggccagttcacaggaagtacaggagtacaggttttgacacaagaacagttggccaatactggtgcccaagcctggattaaaaaggatcagttcttaagagcagccccggtaactggaggaatgggagccgttttgatgagaaaaatgggctggagagaaggagaaggattaggaaaaaacaaagaaggcaataaggaacccatcctagttgattttaagacagaccgaaaaggtcttgttgcagtaggagaaagagcacaaaagaggtctgggaacttctctgctgcaatgaaagatctgtcaggcaaacatcctgtgtctgctttgatggagatctgtaataaaagaaggtggcaaccacctgaatttctattggtccatgatagtggccctgatcatcgcaaacattttctctttagggtattgagaaatggagcccttaccagacccaattgtatgtttttcttgaataggtattgataaatggaagcgcttaccagcccagctttgccagccctaataagaagcatgctaaagccacagcagctactgtggttcttcaagcaatgggccttgtaccaaaggacctcatggctaatgccacttgcttcaggagtgcctcacgtagatagattgaggttttataataatcatttcagaattttactctgcatcacaatgtatttcctctttaatgttgtaaatatttggcaatttaagacattgtgtaaaaagcaatctgtaaaaacatctccaggctttgatttttgtaccatggaaattgtatttaaccatacagggttttggtatgtttatattgtttaccttagtgatgtatttgtttaagtggctaacatccaaacgactgtttgaaggcatcagagtaatcttcagtgtggaatgttaaataacgcttttatactgtattttgtactatgatgtaactccccttccttatggctaggctactgtaacacttgcctgtaatcagtgaagggctgtgcaccttgtactatttcacaatgggttctgctggacagataatgggccagtgttattgaggtgatcaagatctgttccacagggctaatgccaccatctcccctcaaaattttgtagaggttctaaaaagaaagtggtatgttgtgtgatgatcagcactaagtcctgcattcctgttaaagccacttgggtcataagaagggagtaaaaaatgaagtctgactagaattctattgcagaggccagtacatttagtatggcattgagttgtgatatagttttactttgatgtgcattttgaatttcagctacacctagatagacgtaaaatgataattaaaatgctgtaaccaacttatctaataaaattggcaaccagccactattttgttgactatgagaaagttaaaagtttatgttaatttttagggtctgatagaatatttcatgtgtattacagtggtattcatatgctatgtctctaaactttattttcaaaagcttaaggcccaaatacaaacttctctggaataaa

SEQ ID NO: 29472 - DNA, 5489 bp, Homo sapiens
gggaaaggaggtcgccgcccggggtcgcccgggcttgcgggtcgccgcgcttcctctgcgggcgctgcgggaggcgagggccgcctcggcggaggaagccgaccccggggtctccgccagcccgccggcgccgcctccgagccgcctcggccgtagcctcggcccgggcgggaggcggcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagtccattgctgatggttttaaagaggcagttcgttatgtccttccacgtcttatgctggtgccagtgtatcactgttggcactactttgagttactaaagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatggtatttgtaaagttttttttttaatttattcaaaaaaagacatagtattttagtactttttacaaataatgctcttacaaaaatgctactgatcaaataagcttttaagaattggaaaaataaaaatacaaaagtccttcaccattatcctcaggtgatcagtagcattgccttgtcttggatcctcagtgctgccaaaaggccagtataaagaatttatatttgcactgtaaactctgcaaaaatatggtttaaagtgacatgattgcactgaaaagggatagtgcttttgtgaaatttttcaaatttgagtaatagatgcctttttaaggcagtgaatttacacaaatatgggaggggtatatggtgttactgatttttaaacctctttgaccatcttctagtttttacttctagtttttacatctaggagaattgtgaataacaccaactgttcttaaactctttaatgccatgtcttaaatgccggtatttgctgctgaagacaaaaatgaaaagtaggatgaaaataatagaatggcactgtaagtgtttattattttgtcaaaatgtaaacaaagactacataacccaatgatggagggaaaaagggcatgtatctcattcagatgtgccttttgtttttgcagactatgacgtctttagctaatgaattgcctattgttatggaaaacagttaatatgccatgtatgtacagttttgtttatattgtatatttaaagatactgctaataacctatataaatttaagtgacttgaggcctataatacaatctgctactttactaattcataaattcaaaaaaaattctatggcataggaaccaactgccttgccttcaagacctagtaactttctctataaatctcgtgttaactgaaattttttttaaatatattttttagattggtaatatttaaaccagcaaatacttaaagctttattaaacattttaatcagataagtgagtaaagcttttatttgccatttggatgccttcgttcaaagtgatagagtgttttgctgatagtgctgtagcagcagttgtaaagtagccaaaagccacgttgtttatttactggtttgtggccttttactgtgctttgtatcagagttcttaacaagattaataaatcaccccagtcttaatttttaaaag

SEQ ID NO: 29473 - DNA, 3960 bp, Homo sapiens
gatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgatttttcagctgcttaataaattatgcatggcccagccaaggactgttcaagatgtagaggagcgagttcagaagacctttcctcacccaattgataaatgggccattgctgatgcacaatctgctatagaaaaacgaaaacgaagaaatcctcttttactgcctgtggacaaaatccatccttcgttgaaggaagtattagggtacaaagtggactaccatgtatccctatatattgtggctgtactagagtatatctcagctgatattttaaaattggctggtaattatgtttttaatatccggcattatgaaatatctcagcaggacattaaagtgtcaatgtgtgcggataaggttttgatggacatgtttgatcaggatgacataggtttggtttctctctgtgaagatgaacctagttcttctggtgaattaaactactatgatcttgtcagaactgaaatcgcagaagaaagacagtatctacgggaattaaatatgatcataaaagtgtttcgagaagcctttctttctgatagaaagctgtttaaaccttctgatatcgaaaagatttttagtaacatttcagatatacatgaattgactgtgaaacttttaggtttgattgaagacacagttgaaatgactgatgaaagcagtcctcatcccttagctggcagctgttttgaagatttggcagaagagcaagcatttgatccttatgaaacattatcacaggacattctttcaccagagtttcatgaacatttcaataaattgatggccagacctgcagttgctctacactttcagcaattgaaagcatgtagtgaagaacaagaagacagagaatgtttgaaccaagctattactgctctcatgaatctccaaggtagcatggaccgaatttacaagcagtattcacctagacgtcgacctggagatcctgtttgccctttttatagtcaccaattaagaagcaaacacctggctatcaaaaaaatgaatgaaattcagaaaaatatcgatggatgggaaggcaaagatattggacagtgttgtaatgaattcattatggagggaccattgacaagaatcggtgccaaacatgaacggcatatttttctgtttgatggcttaatgatcagttgtaaacctaatcatggccagactcggcttccaggttacagtagtgcagaatacaggttaaaagaaaaatttgtcatgaggaaaatacaaatttgtgataaagaagatacttgtgagcacaagcatgcatttgaattagtatccaaagatgagaacagcataatatttgctgctaagtctgctgaagaaaaaaacaactggatggcagcccttatttctcttcattatcgtagtactctagatcgaatgttagattcagtattattgaaagaagaaaatgagcaaccactgagattaccaagtcctgaagtatatcgttttgtagtaaaagactctgaggaaaacattgtttttgaagacaacttgcaaagtagaagtggcatccccattattaaaggaggaactgtagtgaaattaattgaaaggttaacatatcatatgtatgcagatcccaattttgttcgtacttttcttaccacatatcgttcattttgtaaaccacaggaattgctgagcttactgattgaacggtttgaaattccagagccagaacctactgacgcagacaaattggcaatagagaaaggcgagcagccaatcagtgcagaccttaaaagatttcgcaaggaatatgtccaaccagtacaacttaggatcttaaatgtatttcggcattgggttgaacatcatttttatgactttgaaagagacttggaattgcttgaaagactagaatccttcatttcaagtgtaagagggaaagctatgaaaaaatgggtagagtcaattgctaagatcatcaggaggaagaagcaagctcaggcaaacggagtaagccataatattacctttgaaagtccacctccaccaattgaatggcatatcagcaaaccaggacagtttgaaacatttgatctcatgacacttcatccaatagaaattgcacgtcagctgacacttttggagtctgatctttacaggaaagttcaaccgtctgaacttgtagggagtgtgtggaccaaagaagataaagaaataaattctccaaatttattaaaaatgattcgccataccacaaatctcaccctctggtttgaaaaatgcattgtggaagcagaaaattttgaagaacgggtggcagtactaagtagaattatagaaattctgcaagtttttcaagatttgaataatttcaatggcgtattggagatagtcagtgcagtaaattcagtgtcagtatacagactagaccatacctttgaggcactgcaggaaaggaaaaggaaaattttggacgaagctgtggaattaagtcaagatcactttaaaaaatacctagtaaaacttaagtcaatcaatccaccttgtgtgcctttttttggaatatatttaacaaatattctgaagaccgaagaagggaataatgattttttaaaaaagaaagggaaagatttaatcaatttcagtaagaggaggaaagtagctgaaattactggagaaattcagcagtatcagaatcagccttactgtttacggatagaaccagatatgaggagattctttgaaaaccttaaccccatgggaagtgcatctgaaaaagagtttacagattatttgttcaacaagtcactagaaattgaacctcgaaactgcaaacagccacctcgatttcctaggaaatcaactttttccttaaaatctcctggaataaggcctaacacaggccgacatggctctacctcaggtactttacgaggtcacccaacaccattagaaagagaaccatgtaaaataagctttagtcggattgctgaaactgagctggaatcaacagtgtcagcaccaacctctccaaatacaccatctactccaccagtatctgcttcttcagaccttagtgtatttttagatgtggatctcaacagctcctgtggcagcaatagcatctttgctccagtgcttttgccacattcaaagtctttctttagttcatgtggtagtttacataaactaagtgaagagcccctgattcctcctcctcttcctcctcgaaaaaagtttgatcatgatgcttcaaattccaagggaaatatgaaatctgatgatgatcctcctgctattccaccgagacagcctcctcctccaaaggtaaaacccagagttcctgttcctactggtgcatttgatgggcctctgcatagtccacctccgccaccaccaagagatcctcttcctgatacccctccaccagttccccttcggcctccagaacactttataaactgtccatttaatcttcagccacctccactggggcatcttcacagagattcagactggctcagagacattagtacgtgtccaaattcgccaagcactcctcctagcacaccctctccaagggtaccgcgtcgatgctatgtgctcagttctagtcagaataatcttgctcatcctccagctccccctgttccaccaaggcagaattcaagccctcatctgccaaaactgccaccaaagacttacaaacgggagctttcgcaccccccattgtacagactgcctttgctagaaaatgcagaaactccccaatgaccttagccatatgtagtcattgacactggaatgg

SEQ ID NO: 29474 - DNA, 4454 bp, Homo sapiens
gcgaggcagccagcgagggagagagcgagcgggcgagccggagcgaggaagggaaagcgcaagagagagcgcacacgcacacacccgccgcgcgcactcgcgcacggacccgcacggggacagctcggaagtcatcagttccatgggcgagatgctgctgctggcgagatgtctgctgctagtcctcgtctcctcgctgctggtatgctcgggactggcgtgcggaccgggcagggggttcgggaagaggaggcaccccaaaaagctgacccctttagcctacaagcagtttatccccaatgtggccgagaagaccctaggcgccagcggaaggtatgaagggaagatctccagaaactccgagcgatttaaggaactcacccccaattacaaccccgacatcatatttaaggatgaagaaaacaccggagcggacaggctgatgactcagaggtgtaaggacaagttgaacgctttggccatctcggtgatgaaccagtggccaggagtgaaactgcgggtgaccgagggctgggacgaagatggccaccactcagaggagtctctgcactacgagggccgcgcagtggacatcaccacgtctgaccgcgaccgcagcaagtacggcatgctggcccgcctggcggtggaggccggcttcgactgggtgtactacgagtccaaggcacatatccactgctcggtgaaagcagagaactcggtggcggccaaatcgggaggctgcttcccgggctcggccacggtgcacctggagcagggcggcaccaagctggtgaaggacctgagccccggggaccgcgtgctggcggcggacgaccagggccggctgctctacagcgacttcctcactttcctggaccgcgacgacggcgccaagaaggtcttctacgtgatcgagacgcgggagccgcgcgagcgcctgctgctcaccgccgcgcacctgctctttgtggcgccgcacaacgactcggccaccggggagcccgaggcgtcctcgggctcggggccgccttccgggggcgcactggggcctcgggcgctgttcgccagccgcgtgcgcccgggccagcgcgtgtacgtggtggccgagcgtgacggggaccgccggctcctgcccgccgctgtgcacagcgtgaccctaagcgaggaggccgcgggcgcctacgcgccgctcacggcccagggcaccattctcatcaaccgggtgctggcctcgtgctacgcggtcatcgaggagcacagctgggcgcaccgggccttcgcgcccttccgcctggcgcacgcgctcctggctgcactggcgcccgcgcgcacggaccgcggcggggacagcggcggcggggaccgcgggggcggcggcggcagagtagccctaaccgctccaggtgctgccgacgctccgggtgcgggggccaccgcgggcatccactggtactcgcagctgctctaccaaataggcacctggctcctggacagcgaggccctgcacccgctgggcatggcggtcaagtccagctgaagccggggggccgggggaggggcgcgggagggggcggggcggggcagcaacagcaacgcaaagcaaaaagacactcggaaaaggcgcacgaaccagactgagttataataagaataagaataataaagtaggacagtccaaagtagactctaaggaaacaaggaccccgggaagttttgttgttgtgcttagttgatatatattttttgaatttttttggttattgttttattttggttattttttcctcctctcctggctatttatttgtttggtatgaatagatgttttaaataatatgaaccggaccttcaagagccttaaatagtttgtttcttggataatttattatgatcatgtgaactgtactcacgggggaaagattattttgtgaggccaagcaacctgctcagagtctatttttctacatgtccctcgtcccggctgtcagaaagcaaacctctgtccccgccatccctcccttccatctcctgcttctcagcaagtgcaaactcaaacgtgcttcatgggggtccacaaattatatttttatacacagaattgtaaattagattttttgagagatcaatacttaactgaattacatttcatttttgaaatagtgtaaaatatgaaaatatattattttaatttaactagtttccgatgtaacagccatctcctctgttgtctttatggtttcatattccctttgtattcaccattttgccacattcttggaagccaagactgttacacacacaacatacacacacacttttctttttcttttcttttcttttttttttttttttttttttttggacaaactggaagaactgttatttttaacttcaaagaatttattagaaaataatattttttaaaagcgcacatagtgacgagcccacgaggatggagcctgcagtttgtacagagaaaacaaaggatgtttttgcattaataaattgagaaataacgctgtaaatttactaaaatgtatttttgaatattttgtaatagttttatagaaataaaatgtgccatgcacagaacgcttagtatctaataactaagaattcctgttgcagccctttttcttttagtttttggcttctttgtttgggaaacctagcgctgacaggagctcccaatattctatttagatgtgttgcttatactgtgaactcagactgactgacttaggtaaccaaagtaggcacacaaaccaacttgtttcttctcatggctggagaaacctcagctctgtttgtatttattgtgtgaagctctttctacactcccaaaggttgggagtgccattcgtggggactgtgctgtccccctcaccccaccccttaactagcaaagcctgatgtgtaagcccagaggaggtggcctggggatggccaccaacaaccttctcttaggactcctgtgtgtggttgctgggcagacccctggcctgaccctgtttgtgcttctctgatctgtagggaggaggctcattgctgctttctgaggtcctgttgtgtcccttccagaaagcatccttagaagagaggacccggtttgatcttctctgaagctcctatcctcttttcttgagggtccccttaaatctgagtggcaagcccacagtggcgagggccagtcgctggaatgtcggggctgctgttgaggtcctcaggctacactggttgtctgtgtcacatggcggtcgggcgtggactttgatccctgttgagagagcatgctgctgtgggcgctgggctggggaaggtccttccatgcttcatgctgccttggaggtttggccaagagggtctctgcccttggcggttgtcagggtcccaggtggaggactactcccagttctttggcttacggaaggtgtctgccatgctttgtgctttgggccgaatcgtctgagcaggctgggccttggaagagttgcgctgcatgagcttggggcctcccagcagctgcagcctgtgtagaaggtggtccaggcttagggaacaggagtgaacagacttcagccccacctggcaggggctggctcccgaggttgggcccagtccctgagggtctgctctgctacgggtctgcccttgagtggccttccgtggagggtgtgtgaccaggtggatggcgcagggcctctggagccctctcctcaggagcagtcctcagcctttttctgtaaaagacttttctttggtgttctaggtggtcagcaggttccaggctggtgtttacaatctcggaggaagtgcgatggtttctgttcttttgacagttcagtctgatttcaagtcagtcgaaagcgaaccagaagcaccgggcacagcagctcctctggctgtgtagacagacctggcaatgtggccgtgcagcccagacgatcagagagaagccaggcgttgaccaagccccaaggtgcctgaggccatggtgcaactctgctggtgactggggcaccttggagcagagcttcacccggatgggaaatcctcactcctgggtggcactccctcctggacaggcccggtggcagagtgtccgtgctgctgggtgctgtccccagccctcctggtccatcttcttaagatgcgtccactgctttatatttaaaattctctttttcacaggcaaggaaaggaaaccactgcttagagacactaggtacagggcatcaagagggtgcagcccagccccgccaggacgaggcgccgacttctcattcagggttgacggagccaagagtttgtgcaaaatgtatgcatggtggttgctgccagcctccctcatgactaaatgcatatctattcctgtcaaaacgtgtatcacaatgtacttgaaactgttatctttgtgctctattgtttgaataattaaagaaattacagag

SEQ ID NO: 29475 - DNA, 3517 bp, Homo sapiens
ttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcttacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagacactcctgaagaaaacccttatttccctacgtacaaattccctgaacttcctgaaatccagcaaacttccgaagagacaaagtcttgctctgtcatgtcacccaggctggagtgcagtggtacagtcatagctcactgcagcctcaaactcctagactcaagcaatcctcccacctcagcctcccaagtagctgggactgcagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagtcgggatataagcccagaagagatagatttaaagaatgaaccttggtataaattcttttcggaattggagtttgggaaaccgcctcccaaaaagatatgggattatactcctggagactgctctatccttcctagagaggatagaaagactaatctagacaaagatctcagcctctgccagacagagttagaggcagatttagaaaaaatggagacgcttaataaagcacccagtgcaaacgtgccacagagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagccatggcgcgaagagagtggacaatatgagaggaaagcagagaggggggcaggcgaaagaggccctggtggacccaagatctctaagaagagctgcttgaagccttcagacgtggtcaggtgcctgagtactgaacagagactctcagatctcaacacccctgaggagagccggcccggcaagcccctgggtagcgcttttccaggaagtgaggctgagcagacagagcggcatagaggtggcgagcaggcggggaggaaagctgctcggagaggtgggagccagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattgg

SEQ ID NO: 29476 - DNA, 5858 bp, Homo sapiens
agcgctgagtcccagaaaaacagagcggggccagctgcagcgtgtagtgcgagtggggcggacgcgcgcagcccgcccgcccggcgaccagcaaggagttggcatcctttggaagagttcgtgaaagctttctgcccagagctcctggaccaatgcatcttcccaccaccttaaaccactgagcagttcagagccccagttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcttacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggca

SEQ ID NO: 29477 - DNA, 6016 bp, Homo sapiens
gcagcgtgtagtgcgagtggggcggacgcgcgcagcccgcccgcccggcgaccagcaaggagttggcatcctttggaagagttcgtgaaagctttctgcccagagctcctggaccaatgcatcttcccaccaccttaaaccactgagcagttcagagccccagttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcttacaaaaatctgcactgggaagggagcggtgactctccgggcctcgtcttcctacagggaaaccccaagcagtagccctgcgagccctcaggaaacccggcaacacgaaagcaaaccagatgagtggaggctttcttccagtgctgatgccaatggaaatgcccagccctcttcactcgctgccaagggctacagaagtgtgcatcccaaccttccttctgacaagtcccaggattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagacactcctgaagaaaacccttatttccctacgtacaaattccctgaacttcctgaaatccagcaaacttccgaagaggacaatccttacactcccacctaccagtttcctgcatctactcctagtcctaaatctgaagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagtcgggatataagcccagaagagatagatttaaagaatgaaccttggtataaattcttttcggaattggagtttgggaaaccgagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggc

SEQ ID NO: 29478 - DNA, 6193 bp, Homo sapiens
gcagcgtgtagtgcgagtggggcggacgcgcgcagcccgcccgcccggcgaccagcaaggagttggcatcctttggaagagttcgtgaaagctttctgcccagagctcctggaccaatgcatcttcccaccaccttaaaccactgagcagttcagagccccagttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcttacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagtcgggatataagcccagaagagatagatttaaagaatgaaccttggtataaattcttttcggaattggagtttgggaaaccgcctcccaaaaagatatgggattatactcctggagactgctctatccttcctagagaggatagaaagagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagctttctcatcattcattgagagcaggaccagatctcacagaatctgaaaagagctatgtgcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggc

SEQ ID NO: 29479 - DNA, 3015 bp, Homo sapiens
atgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcttacaaaaatctgcactgggaagggagcggtgactctccgggcctcgtcttcctacagggaaaccccaagcagtagccctgcgagccctcaggaaacccggcaacacgaaagcaaaccagatgagtggaggctttcttccagtgctgatgccaatggaaatgcccagccctcttcactcgctgccaagggctacagaagtgtgcatcccaaccttccttctgacaagtcccaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagacactcctgaagaaaacccttatttccctacgtacaaattccctgaacttcctgaaatccagcaaacttccgaagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagtcgggatataagcccagaagagatagatttaaagaatgaaccttggtataaattcttttcggaattggagtttgggaaaccgcctcccaaaaagatatgggattatactcctggagactgctctatccttcctagagaggatagaaagactaatctagacaaagatctcagcctctgccagacagagttagaggcagatttagaaaaaatggagacgcttaataaagcacccagtgcaaacgtgccacagagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataa

SEQ ID NO: 29480 - DNA, 3940 bp, Homo sapiens
ttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcttacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagacactcctgaagaaaacccttatttccctacgtacaaattccctgaacttcctgaaatccagcaaacttccgaagaggacaatccttacactcccacctaccagtttcctgcatctactcctagtcctaaatctgaagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagtcgggatataagcccagaagagatagatttaaagaatgaaccttggtataaattcttttcggaattggagtttgggaaaccgcctcccaaaaagatatgggattatactcctggagactgctctatccttcctagagaggatagaaagactaatctagacaaagatctcagcctctgccagacagagttagaggcagatttagaaaaaatggagacgcttaataaagcacccagtgcaaacgtgccacagagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagttttccagtcacagcaagctcatcacgccagccccctcatctctgccccactcccgccgagccctgtcccccgagatgcacgctgtcacctctgagtggatctcactgactgtgggggtcccaggcaggcgttctctggccctgaccccacccttgcctcctctgccagaggcttctatctataacactgaccacctcgccttgtcaccaagggccagtccctccctgtctctcagcctcccccatttgagttggtcagatcgtcccaccccacgatcagtagcttctccactggccctaccttccccacacaaaacctactccctagcacctacttcccaggcctcccttcacatgaatggagacggtggtgtccacacgccatcttcaggcatccaccaagatagcttcttgcagctgccgctggggagctctgatagtgtcatctcccagcttagtgatgcctttagcagccagagcaagaggcagccatggcgcgaagagagtggacaatatgagaggaaagcagagaggggggcaggcgaaagaggccctggtggacccaagatctctaagaagagctgcttgaagccttcagacgtggtcaggtgcctgagtactgaacagagactctcagatctcaacacccctgaggagagccggcccggcaagcccctgggtagcgcttttccaggaagtgaggctgagcagacagagcggcatagaggtggcgagcaggcggggaggaaagctgctcggagaggtgggagccagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattgg

SEQ ID NO: 29481 - DNA, 7276 bp, Homo sapiens
gcagcgtgtagtgcgagtggggcggacgcgcgcagcccgcccgcccggcgaccagcaaggagttggcatcctttggaagagttcgtgaaagctttctgcccagagctcctggaccaatgcatcttcccaccaccttaaaccactgagcagttcagagccccagttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcttacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagtcgggatataagcccagaagagatagatttaaagaatgaaccttggtataaattcttttcggaattggagtttgggaaaccgcctcccaaaaagatatgggattatactcctggagactgctctatccttcctagagaggatagaaagactaatctagacaaagatctcagcctctgccagacagagttagaggcagatttagaaaaaatggagacgcttaataaagcacccagtgcaaacgtgccacagagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagttttccagtcacagcaagctcatcacgccagccccctcatctctgccccactcccgccgagccctgtcccccgagatgcacgctgtcacctctgagtggatctcactgactgtgggggtcccaggcaggcgttctctggccctgaccccacccttgcctcctctgccagaggcttctatctataacactgaccacctcgccttgtcaccaagggccagtccctccctgtctctcagcctcccccatttgagttggtcagatcgtcccaccccacgatcagtagcttctccactggccctaccttccccacacaaaacctactccctagcacctacttcccaggcctcccttcacatgaatggagacggtggtgtccacacgccatcttcaggcatccaccaagatagcttcttgcagctgccgctggggagctctgatagtgtcatctcccagcttagtgatgcctttagcagccagagcaagaggcagccatggcgcgaagagagtggacaatatgagaggaaagcagagaggggggcaggcgaaagaggccctggtggacccaagatctctaagaagagctgcttgaagccttcagacgtggtcaggtgcctgagtactgaacagagactctcagatctcaacacccctgaggagagccggcccggcaagcccctgggtagcgcttttccaggaagtgaggctgagcagacagagcggcatagaggtggcgagcaggcggggaggaaagctgctcggagaggtgggagccagctttctcatcattcattgagagcaggaccagatctcacagaatctgaaaagagctatgtgcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggc

SEQ ID NO: 29482 - DNA, 2436 bp, Homo sapiens
atgagttctgaatgtgatggtggttccaaagctgtgatgaatggcttggcacctggcagcaatgggcaagacaaagacatggatcttacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagtcgggatataagcccagaagagatagatttaaagaatgaaccttggtataaattcttttcggaattggagtttgggaaaccgactaatctagacaaagatctcagcctctgccagacagagttagaggcagatttagaaaaaatggagacgcttaataaagcacccagtgcaaacgtgccacagagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataa

SEQ ID NO: 29483 - DNA, 2055 bp, Homo sapiens
atgagttctgaatgtgatggtggttccaaagctgtgatgaatggcttggcacctggcagcaatgggcaagacaaagacatggatcttacaaaaatctgcactgggaagggagcggtgactctccgggcctcgtcttcctacagggaaaccccaagcagtagccctgcgagccctcaggaaacccggcaacacgaaagcaaaccagatgagtggaggctttcttccagtgctgatgccaatggaaatgcccagccctcttcactcgctgccaagggctacagaagtgtgcatcccaaccttccttctgacaagtcccaggattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataa

SEQ ID NO: 29484 - DNA, 6033 bp, Homo sapiens
ttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcttacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagtcgggatataagcccagaagagatagatttaaagaatgaaccttggtataaattcttttcggaattggagtttgggaaaccgcctcccaaaaagatatgggattatactcctggagactgctctatccttcctagagaggatagaaagagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagctttctcatcattcattgagagcaggaccagatctcacagaatctgaaaagagctatgtgcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggcata

SEQ ID NO: 29485 - DNA, 6931 bp, Homo sapiens
gcagcgtgtagtgcgagtggggcggacgcgcgcagcccgcccgcccggcgaccagcaaggagttggcatcctttggaagagttcgtgaaagctttctgcccagagctcctggaccaatgcatcttcccaccaccttaaaccactgagcagttcagagccccagttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcttacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagacactcctgaagaaaacccttatttccctacgtacaaattccctgaacttcctgaaatccagcaaacttccgaagagacaaagtcttgctctgtcatgtcacccaggctggagtgcagtggtacagtcatagctcactgcagcctcaaactcctagactcaagcaatcctcccacctcagcctcccaagtagctgggactgcagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagtcgggatataagcccagaagagatagatttaaagaatgaaccttggtataaattcttttcggaattggagtttgggaaaccgcctcccaaaaagatatgggattatactcctggagactgctctatccttcctagagaggatagaaagactaatctagacaaagatctcagcctctgccagacagagttagaggcagatttagaaaaaatggagacgcttaataaagcacccagtgcaaacgtgccacagagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagccatggcgcgaagagagtggacaatatgagaggaaagcagagaggggggcaggcgaaagaggccctggtggacccaagatctctaagaagagctgcttgaagccttcagacgtggtcaggtgcctgagtactgaacagagactctcagatctcaacacccctgaggagagccggcccggcaagcccctgggtagcgcttttccaggaagtgaggctgagcagacagagcggcatagaggtggcgagcaggcggggaggaaagctgctcggagaggtgggagccagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggc

SEQ ID NO: 29486 - DNA, 7354 bp, Homo sapiens
gcagcgtgtagtgcgagtggggcggacgcgcgcagcccgcccgcccggcgaccagcaaggagttggcatcctttggaagagttcgtgaaagctttctgcccagagctcctggaccaatgcatcttcccaccaccttaaaccactgagcagttcagagccccagttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcttacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagacactcctgaagaaaacccttatttccctacgtacaaattccctgaacttcctgaaatccagcaaacttccgaagaggacaatccttacactcccacctaccagtttcctgcatctactcctagtcctaaatctgaagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagtcgggatataagcccagaagagatagatttaaagaatgaaccttggtataaattcttttcggaattggagtttgggaaaccgcctcccaaaaagatatgggattatactcctggagactgctctatccttcctagagaggatagaaagactaatctagacaaagatctcagcctctgccagacagagttagaggcagatttagaaaaaatggagacgcttaataaagcacccagtgcaaacgtgccacagagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagttttccagtcacagcaagctcatcacgccagccccctcatctctgccccactcccgccgagccctgtcccccgagatgcacgctgtcacctctgagtggatctcactgactgtgggggtcccaggcaggcgttctctggccctgaccccacccttgcctcctctgccagaggcttctatctataacactgaccacctcgccttgtcaccaagggccagtccctccctgtctctcagcctcccccatttgagttggtcagatcgtcccaccccacgatcagtagcttctccactggccctaccttccccacacaaaacctactccctagcacctacttcccaggcctcccttcacatgaatggagacggtggtgtccacacgccatcttcaggcatccaccaagatagcttcttgcagctgccgctggggagctctgatagtgtcatctcccagcttagtgatgcctttagcagccagagcaagaggcagccatggcgcgaagagagtggacaatatgagaggaaagcagagaggggggcaggcgaaagaggccctggtggacccaagatctctaagaagagctgcttgaagccttcagacgtggtcaggtgcctgagtactgaacagagactctcagatctcaacacccctgaggagagccggcccggcaagcccctgggtagcgcttttccaggaagtgaggctgagcagacagagcggcatagaggtggcgagcaggcggggaggaaagctgctcggagaggtgggagccagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggc

SEQ ID NO: 29487 - DNA, 5927 bp, Homo sapiens
gcagcgtgtagtgcgagtggggcggacgcgcgcagcccgcccgcccggcgaccagcaaggagttggcatcctttggaagagttcgtgaaagctttctgcccagagctcctggaccaatgcatcttcccaccaccttaaaccactgagcagttcagagccccagttgcagacgacttgtcctgccaccaccatgagttctgaatgtgatggtggttccaaagctgtgatgaatggcttggcacctggcagcaatgggcaagacaaagacatggatcttacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggca

SEQ ID NO: 29488 - DNA, 6490 bp, Homo sapiens
gcagcgtgtagtgcgagtggggcggacgcgcgcagcccgcccgcccggcgaccagcaaggagttggcatcctttggaagagttcgtgaaagctttctgcccagagctcctggaccaatgcatcttcccaccaccttaaaccactgagcagttcagagccccagttgcagacgacttgtcctgccaccaccatgagttctgaatgtgatggtggttccaaagctgtgatgaatggcttggcacctggcagcaatgggcaagacaaagcaactgccgaccctttacgcgcacgctctatttctgctgttaaaatcattcctgtgaagacagtgaaaaacgcctcaggcctagttctccctacagacatggatcttacaaaaatctgcactgggaagggagcggtgactctccgggcctcgtcttcctacagggaaaccccaagcagtagccctgcgagccctcaggaaacccggcaacacgaaagcaaaccagatgagtggaggctttcttccagtgctgatgccaatggaaatgcccagccctcttcactcgctgccaagggctacagaagtgtgcatcccaaccttccttctgacaagtcccaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagacactcctgaagaaaacccttatttccctacgtacaaattccctgaacttcctgaaatccagcaaacttccgaagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagtcgggatataagcccagaagagatagatttaaagaatgaaccttggtataaattcttttcggaattggagtttgggaaaccgcctcccaaaaagatatgggattatactcctggagactgctctatccttcctagagaggatagaaagactaatctagacaaagatctcagcctctgccagacagagttagaggcagatttagaaaaaatggagacgcttaataaagcacccagtgcaaacgtgccacagagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagaaacttttagcggaccagagacgacttaaacgcgagcaagaagaggctgatattgcagctcgacgccacacaggcgtcattccgacgcaccatcagtttatcactaatgagcgctttggggacctcctcaatatagacgatactgcaaaaaggaaatctgggtcagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggc

SEQ ID NO: 29489 - DNA, 3459 bp, Homo sapiens
cgcgcgcgccccgacggacggagagcactcgcacgtccctcctctccggcccagccccggcccgcagtccagatccgagacccaaactccgcccgccccgccgcgcgactctcacggtccggcctccggcgcgcgccccttcggcctccctcttcctgcgccggcgcccggcccggcccggcccgtcctgacccggtcacgagggccgcgacggcccgcgcttctccttgcccttcctcctcgagcgcccgcgccaggcagcagccgggcagggatgctcctgcgctcccgggcggcctcgggcccagccacctgctcgccggggaagaggacacgcagaggagcagctggcttgcccggagtcctcccaccttgacccaagcatgcagggcccaccccgcagcctccgcgctgggctcagcctggacgacttcatccctggccacctccagtcccacatagggtcttcctcccgggggacacgggtgcccgtgatccggaatggtggctccaacacccttaatttccagttccacgaccccgcgcccaggactgtgtgcaatgggggctacacaccaagacgagatgcttcccagcacccggaccctgcgtggtatcagacctggccaggccctgggagcaagccctctgcaagcacaaagatccctgcctcccagcacacccagaactggtcagccacgtggaccaaggacagcaagcgtcgggacaagcgctgggtcaagtacgagggaatcgggcccgtggacgagagcggcatgcccattgccccccgatccagcgttgacagacccagagactggtaccggagaatgttccagcagattcaccggaaaatgccagacttgcagctggactggaccttcgaggagccacccagagaccccaggcatctaggagcccagcaaagacctgcccacaggcccggcccggcaacatcttccagtggaagaagctgggaccactctgaagagttacctagaagcaccttcaactacagacctggagcattctccactgtgctgcagccctcaaatcaggtgctcagacgccgggaaaaagtagacaatgtctggacggaagagtcctggaaccagtttctgcaggaactagagactgggcagaggcccaagaaaccgctggtggacgaccctggtgagaagccctcccagcccattgaggtgctgctggagagagagctggccgagctgagcgccgagctggacaaggacctgcgggcaattgagacccgactgccgtcccccaagagctcgccggcgccccgacgggccccggagcagcggcccccggccggcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccatcgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaagggaccttgtctctgcggccttttccttggggtaggggatgcctcctcctgtctaggagatgggaattccttctgtggagggctgtgctgggagacaggtgggacaggtgtgtgtgtaagaggaggaggatggaaaaacaccattattacctccaaagatctctgcccttgggtgtcaggcaggttgcggcagcccccacaattgggcagctgtgtggcaagaagtgctgggagaatgaacagtgccaggccctggtagcagggagacaccagagatgggggactgaatgtggcctt

SEQ ID NO: 29490 - DNA, 2039 bp, Homo sapiens
cccgccccgctcccgggatcggccgcgcgggcgcctctaggaccccgcgtcccgcccgctctcctcccctcccgagccgcgaacttttccggaggcggcggcctcggctgccgctgggtcccggggtcgcgggccctgattgcgccgtttccccgcgcagagctcgccggcgccccgacgggccccggagcagcggcccccggccggcccggcctcagcctggagctccagctacccacatgcaccttacctgggttccgcccggtccctgagtccccacaaaatggctgatggaggaagccccttcctaggtcggagggactttgtctacccttcctcaacccgagaccctagtgcctctaacggagggggcagcccagccaggagggaagagaagaagagaaaggccgccaggctcaagtttgacttccaggcgcagtcccccaaggagctgactctgcagaagggtgacattgtctacatccacaaggaggtggacaagaactggctggagggagagcaccacggccgcctgggcatcttccctgctaattatgtggaggtgctgcccgcagatgagatccctaagcccatcaagcccccgacctaccaggtgctggagtatggagaggctgtggcccagtacaccttcaagggggacctggaggtggagctgtccttccgcaagggagagcacatctgcctgatccgcaaggtgaacgagaactggtacgagggacgcatcacgggcacggggcgccaaggcatattccctgccagctacgtgcaggtgtctcgtgaaccccggctccggctctgtgacgacggcccccagctccccacgtctccccgcctgaccgctgccgcccgctcagcccgtcaccccagctccccctcagccctgcgcagcccagctgaccccatcgacttggggggacagacctccccccgtcgcactggcttctccttccccacccaggagcctagaccccagacccagaatcttggcacccctggtccagctctgtcccactctcgaggtcccagccatcccctggacctggggacctcctctcctaacacctctcagatacactggaccccgtaccgggcgatgtaccagtacaggccccagaacgaagacgagctggagctgcgcgagggggacagggtggatgtcatgcagcagtgtgacgatggctggtttgtgggtgtctcccggaggacccagaaattcggaacgttccctggaaattacgttgccccggtgtgagtggtctccatggcaacttggagccagccaggatggggtggggagcggtggcactcgtgggagggagaggacccccgcccacatcctccttccccaggacctgagctcccagcatctgcagacgacccccgcagcctttccctcggacccccctcgaagccccctggactgattcccacccacgactcacaggcattcctcccacagccctttcatttcctccccaccccactccccaaatacagaggtctgctttgaagcggagaccatttccaggccttattgagaccagaccccaagtcccccacccccatcctgctccagcgtttcctctaacagggaccagctctccgctttgcccccacggggttcctctaaccagaaccagcttcctagcctcgtagagaccaaaggccgcccccgcctgctggggttcctcccagcaccccagcttgctggctgccctctttgccttctggcctccagctgggtgtgggggggcggagcaaggcgggggacagacgcagcaccttcttagcgatctaggcctggcaagagctctggccccaaggcctcctcttcccaggggctgccaagtcctggccctggccctggcatatcaccccgcactgtggggccaggcaccactagcctggctcaaatattccccagggagactgctgtgtgctgcccgcctgcctgctggctctcccccagccccacatcccctctggaagagaatgtaaaataaacctggacacaaggg

SEQ ID NO: 29491 - DNA, 2569 bp, Homo sapiens
ctccacgctagcgccgcccaggctggcacaaaggaggaagcctagtcccgcccctgcgtgcggcgcttctcccaggccccaccttccatccagtgccctggaccctcggctgggtagcgccaccagagcgaccaaacgtcccgcgccttccaggccgcactccagagccaaaagagctccatggcggcggcggccaagcccaacaacctttccctggtggtgcacggaccgggggacttgcgcctggagaactatcctatccctgaaccaggcccaaatgaggtcttgctgaggatgcattctgttggaatctgtggctcagatgtccactactgggagtatggtcgaattgggaattttattgtgaaaaagcccatggtgctgggacatgaagcttcgggaacagtcgaaaaagtgggatcatcggtaaagcacctaaaaccaggtgatcgtgttgccatcgagcctggtgctccccgagaaaatgatgaattctgcaagatgggccgatacaatctgtcaccttccatcttcttctgtgccacgccccccgatgacgggaacctctgccggttctataagcacaatgcagccttttgttacaagcttcctgacaatgtcacctttgaggaaggcgccctgatcgagccactttctgtggggatccatgcctgcaggagaggcggagttaccctgggacacaaggtccttgtgtgtggagctgggccaatcgggatggtcactttgctcgtggccaaagcaatgggagcagctcaagtagtggtgactgatctgtctgctacccgattgtccaaagccaaggagattggggctgatttagtcctccagatctccaaggagagccctcaggaaatcgccaggaaagtagaaggtcagctggggtgcaagccggaagtcaccatcgagtgcacgggggcagaggcctccatccaggcgggcatctacgccactcgctctggtgggaacctcgtgcttgtggggctgggctctgagatgaccaccgtacccctactgcatgcagccatccgggaggtggatatcaagggcgtgtttcgatactgcaacacgtggccagtggcgatttcgatgcttgcgtccaagtctgtgaatgtaaaacccctcgtcacccataggtttcctctggagaaagctctggaggcctttgaaacatttaaaaagggattggggttgaaaatcatgctcaagtgtgaccccagtgaccagaatccctgatgttaatgggctctgccctcatccccacagtcttgggatctcagggcacaatggctggacatgggtgggctctgatgcagaactttctcttttgaatgttaagaataactaatacaattcattgtgaacagaagtccttaagcagaggaattggtgtgccttaaagatacaatctgggatagtttgggggaacttgtagccagaatgccctgttcatgctgagcaaagttcagcaagtagagcagagtttggcaggcaggtgccaggaactccccttcttcctggagtgccttcattgaggaaggaaatctggcccttgggtttcctggttccactgctactgacccagaggggaatgagggctgagttatgaaaagataacttcatgaagacttaactggcccagaagctgattttcatgaaaatctgccactcagggtctgggatgaaggcttgtcagcacttccagtttagaacgcaatgtttctagagacatattggctgtttgttttgatgataaaaggagaataagaaaaggcatcactttcctggatccaggataatttttaaaccaatcaaatgaaaaaaacaaacaaacaaaaaaggaaatgtcatgtgaggttaaaccagtttgcattcccctaatgtggaaaaagtaagaggactactcagcactgtttgaagattgcctcttctacagcttctgagaattgtgttatttcacttgccaagtgaaggaccccctccccaacatgccccagcccacccctaagcatggtcccttgtcaccaggcaaccaggaaactgctacttgtggacctcaccagagaccaggagggtttggttagctcacaggacttcccccaccccagaagattagcatcccatactagactcatactcaactcaactaggctcatactcaattgatggttattagacaattccatttctttctggttattataaacagaaaatctttcctcttctcattaccagtaaaggctcttggtatctttctgttggaatgatttctatgaacttgtcttattttaatggtgggttttttttctggtaagatttagacctaaatcgcatcatgccaacttgtgactttgagactattcatcaagaatgaggatatagtagccatgacatagcttgagctatagcctttaattccttactttggctatgggtggagggtgagtttgaagaggttctgattttcttgtaacctgggaaagccatgaccttgtgcccgattctttcagattgctttgggtaataaatattggtggtggtatctgactca

SEQ ID NO: 29492 - DNA, 2010 bp, Homo sapiens
gggcggagaggcctggcgcacagggcgagggcggctgcggcgcagtctgcagcatggcgtacccggggcatcctggcgccggcggcgggtactacccaggcgggtatggaggggctcccggagggcctgcgtttcccggacaaactcaggatccgctgtatggttactttgctgctgtagctggacaggatgggcagatagatgctgatgaattgcagagatgtctgacacagtctggcattgctggaggatacaaaccttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttggaactttaataagatctagtctgttacaccatttagaactttcctgagccattatcagtcatgccttattttcttgctaaaactctatgtaaatttaagtatgcaaaatgtttaagtcacattatttatttttcattgtgagacactaaaaactgttaatcagactacagctgttatctttcctctcctacaaagaatactccacacataaaaacttaggtaaatgacatagacgcacttgggtgaaataaaacaacaaaaaaggtaatccagtaatccacgtcaggattcaccttagaagtttagcacacgcccttcaaaacctgttgaataatttgattggcaaatactatctgtcaccaagtccctttttgtcatctatttaaacctttgttaactctccttaaaaatcttgtacattataagcttaactatataaaaagaaaattgatagaaaaagactaagggaatatatggaaatattaacaatgtttattttggatgaatggaattctagatgactttaattttctttatatcagtatttttcagattttctatatgctttccttttaaaatcagattttagtttttaaaatactgatacatccattttgatataccatgtattcacactttaaaaaatacacatagcagagtatcggaaagtatgtaccaaaacattgatctggctaccactgggagtcaggatcatgagttcatcttcttccttcttactgcttttccaaacattctccagtaagcaggtactacatttataatggaaggaattttttaaaaaattttaagctgtacactttcaagtaagatctgaattctaatgctggcttgtgcctcttactatgtggtttggtcattatagataatgcccagtttcagtttccccatctttgaaaaggagataatatgttatctcttgggagtagttctgaatatgaagtgtgttgatacaagaagcactgacaatgtttctgtttcttaaatttaaaactggcctggtttgccttttttatcaagagagcttaacagataaaaaatgaaattagtctattttctacttgccagcagagtatctgtcttattttaggatgcagtgtgaaacttaccattcaactgaacaactagttgtcaactaatgaaaataaaacattttctctaa

SEQ ID NO: 29493 - DNA, 653 bp, Homo sapiens
gattcttctatttggccactctgcaagaaggcaatcctctaaggatcaccagcttctacctataagacttcaactcaagatgcagtatggaggggctcccggagggcctgcgtttcccggacaaactcaggatccgctgtatggttactttgctgctgtagctggacaggatgggcagatagatgctgatgaattgcagagatgtctgacacagtctggcattgctggaggatacaaaccttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatttcattcaatgtgtcatgagtgtttaaatcaagaggaagctgcatgaat

SEQ ID NO: 29494 - DNA, 1418 bp, Homo sapiens
actctgcaagaaggcaatcctctaaggatcaccagcttctacctataagacttcaactcaagatgcagtatggaggggctcccggagggcctgcgtttcccggacaaactcaggatccgctgtatggttactttgctgctgtagctggacaggatgggcagatagatgctgatgaattgcagagatgtctgacacagtctggcattgctggaggatacaaaccttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatgtaagtcttagaaattaagagatacagtagatgaaaaggatgtacaccagatgggtatccctttgaaattagctgttaagaatatcttaaggttaaggatgccagagacataagggattcaaaagttagaaagagttatcatccagaatttattaatttcatttattagtcttaactatagtgagaccatgatttgatttgcattcagagacctgggttcaagacccagcttgttgtatttattagctgggtcacttaagcaggtttcttaattgctgtgacactatatgaataaagaagatatagtagtaatgcctttttcactgagccattgtaagatttctattagaaatgcccttgaaaaacactatgcagatatactatctgcttttgtcttctgtaaacaaatcatgtcagtcactgagaatagataacagctcaatagttttgcatacctatgttcttcattgagggcataaggcaggcaacaacttaaatcacaattttttttttttttttgagatggagtctcgctctgttgcccaggttggagtgcagtggcgcaatgtcagctcactgcaacctccacgtctcgggttctagcgattctcctgcctcagcctcctgagggactataggcatgtgccaccatacctggttaagtttttttgtatttttagtagagacggggtttcactgtgttagccaggatggtctcgatctcctgtccttgtgatctgtccgcttaggcctcccaaagtgctgggattacaggcgtgagccactgctcccggctaaatcacaatttaaaacaagttatttactaaacag

SEQ ID NO: 29495 - DNA, 10889 bp, Homo sapiens
cccggagcggcgcgggcggcctggagccccgggagcggcgcgcgcggtcccggcccagcggctctcctggcctcgcgctgcacattctctcctggcggcggcgccacctgcagtagcgttcgcccgaacatggcgacacggagcagcaggagggagtcgcgactcccgttcctattcaccctggtcgcactgctgccgcccggagctctctgcgaagtctggacgcagaggctgcacggcggcagcgcgcccttgccccaggaccggggcttcctcgtggtgcagggcgacccgcgcgagctgcggctgtgggcgcgcggggatgccaggggggcgagccgcgcggacgagaagccgctccggaggaaacggagcgctgccctgcagcccgagcccatcaaggtgtacggacaggttagtctgaatgattcccacaatcagatggtggtgcactgggctggagagaaaagcaacgtgatcgtggccttggcccgagatagcctggcattggcgaggcccaagagcagtgatgtgtacgtgtcttacgactatggaaaatcattcaagaaaatttcagacaagttaaactttggcttgggaaataggagtgaagctgttatcgcccagttctaccacagccctgcggacaacaagcggtacatctttgcagacgcttatgcccagtacctctggatcacgtttgacttctgcaacactcttcaaggcttttccatcccatttcgggcagctgatctcctcctacacagtaaggcctccaaccttctcttgggctttgacaggtcccaccccaacaagcagctgtggaagtcagatgactttggccagacctggatcatgattcaggaacatgtcaagtccttttcttggggaattgatccctatgacaaaccaaataccatctacattgaacgacatgaaccctctggctactccactgtcttccgaagtacagatttcttccagtcccgggaaaaccaggaagtgatccttgaggaagtgagagattttcagcttcgggacaagtacatgtttgctacaaaggtggtgcatctcttgggcagtgaacagcagtcttctgtccagctctgggtctcctttggccggaagcccatgagagcagcccagtttgtcacaagacatcctattaatgaatattacatcgcagatgcctccgaggaccaggtgtttgtgtgtgtcagccacagtaacaaccgcaccaatttatacatctcagaggcagaggggctgaagttctccctgtccttggagaacgtgctctattacagcccaggaggggccggcagtgacaccttggtgaggtattttgcaaatgaaccatttgctgacttccaccgagtggaaggattgcaaggagtctacattgctactctgattaatggttctatgaatgaggagaacatgagatcggtcatcacctttgacaaagggggaacctgggagtttcttcaggctccagccttcacgggatatggagagaaaatcaattgtgagctttcccagggctgttcccttcatctggctcagcgcctcagtcagctcctcaacctccagctccggagaatgcccatcctgtccaaggagtcggctccaggcctcatcatcgccactggctcagtgggaaagaacttggctagcaagacaaacgtgtacatctctagcagtgctggagccaggtggcgagaggcacttcctggacctcactactacacatggggagaccacggcggaatcatcacggctattgcccagggcatggaaaccaacgagctaaaatacagtaccaatgaaggggagacctggaaaacattcatcttctctgagaagccagtgtttgtgtatggcctcctcacagaacctggggagaagagcactgtcttcaccatctttggctcgaacaaagagaatgtccacagctggctgatcctccaggtcaatgccacggatgccttgggagttccctgcacagagaatgactacaagctgtggtcaccatctgatgagcgggggaatgagtgtttgctgggacacaagactgttttcaaacggcggaccccccatgccacatgcttcaatggagaggactttgacaggccggtggtcgtgtccaactgctcctgcacccgggaggactatgagtgtgacttcggtttcaagatgagtgaagatttgtcattagaggtttgtgttccagatccggaattttctggaaagtcatactcccctcctgtgccttgccctgtgggttctacttacaggagaacgagaggctaccggaagatttctggggacacttgtagcggaggagatgttgaagcgcgactggaaggagagctggtcccctgtcccctggcagaagagaacgagttcattctgtatgctgtgaggaaatccatctaccgctatgacctggcctcgggagccaccgagcagttgcctctcaccgggctacgggcagcagtggccctggactttgactatgagcacaactgtttgtattggtccgacctggccttggacgtcatccagcgcctctgtttgaatggaagcacagggcaagaggtgatcatcaattctggcctggagacagtagaagctttggcttttgaacccctcagccagctgctttactgggtagatgcaggcttcaaaaagattgaggtagctaatccagatggcgacttccgactcacaatcgtcaattcctctgtgcttgatcgtcccagggctctggtcctcgtgccccaagagggggtgatgttctggacagactggggagacctgaagcctgggatttatcggagcaatatggatggttctgctgcctatcacctggtgtctgaggatgtgaagtggcccaatggcatctctgtggacgaccagtggatttactggacggatgcctacctggagtgcatagagcggatcacgttcagtggccagcagcgctctgtcattctggacaacctcccgcacccctatgccattgctgtctttaagaatgaaatctactgggatgactggtcacagctcagcatattccgagcttccaaatacagtgggtcccagatggagattctggcaaaccagctcacggggctcatggacatgaagattttctacaaggggaagaacactggaagcaatgcctgtgtgcccaggccatgcagcctgctgtgcctgcccaaggccaacaacagtagaagctgcaggtgtccagaggatgtgtccagcagtgtgcttccatcaggggacctgatgtgtgactgccctcagggctatcagctcaagaacaatacctgtgtcaaacaagagaacacctgtcttcgcaaccagtatcgctgcagcaacgggaactgtatcaacagcatttggtggtgtgactttgacaacgactgtggagacatgagcgatgagagaaactgccctaccaccatctgtgacctggacacccagtttcgttgccaggagtctgggacttgtatcccactgtcctataaatgtgaccttgaggatgactgtggagacaacagtgatgaaagtcattgtgaaatgcaccagtgccggagtgacgagtacaactgcagttccggcatgtgcatccgctcctcctgggtatgtgacggggacaacgactgcagggactggtctgatgaagccaactgtaccgccatctatcacacctgtgaggcctccaacttccagtgccgaaacgggcactgcatcccccagcggtgggcgtgtgacggggatacggactgccaggatggttccgatgaggatccagtcaactgtgagaagaagtgcaatggattccgctgcccaaacggcacttgcatcccatccagcaaacattgtgatggtctgcgtgattgctctgatggctccgatgaacagcactgcgagcccctctgtacgcacttcatggactttgtgtgtaagaaccgccagcagtgcctgttccactccatggtctgtgacggaatcatccagtgccgcgacgggtccgatgaggatgcggcgtttgcaggatgctcccaagatcctgagttccacaaggtatgtgatgagttcggtttccagtgtcagaatggagtgtgcatcagtttgatttggaagtgcgacgggatggatgattgcggcgattattctgatgaagccaactgcgaaaaccccacagaagccccaaactgctcccgctacttccagtttcggtgtgagaatggccactgcatccccaacagatggaaatgtgacagggagaacgactgtggggactggtctgatgagaaggattgtggagattcacatattcttcccttctcgactcctgggccctccacgtgtctgcccaattactaccgctgcagcagtgggacctgcgtgatggacacctgggtgtgcgacgggtaccgagattgtgcagatggctctgacgaggaagcctgccccttgcttgcaaacgtcactgctgcctccactcccacccaacttgggcgatgtgaccgatttgagttcgaatgccaccaaccgaagacgtgtattcccaactggaagcgctgtgacggccaccaagattgccaggatggccgggacgaggccaattgccccacacacagcaccttgacttgcatgagcagggagttccagtgcgaggacggggaggcctgcattgtgctctcggagcgctgcgacggcttcctggactgctcggacgagagcgatgaaaaggcctgcagtgatgagttgactgtgtacaaagtacagaatcttcagtggacagctgacttctctggggatgtgactttgacctggatgaggcccaaaaaaatgccctctgcttcttgtgtatataatgtctactacagggtggttggagagagcatatggaagactctggagacccacagcaataagacaaacactgtattaaaagtcttgaaaccagataccacgtatcaggttaaagtacaggttcagtgtctcagcaaggcacacaacaccaatgactttgtgaccctgaggaccccagagggattgccagatgcccctcgaaatctccagctgtcactccccagggaagcagaaggtgtgattgtaggccactgggctcctcccatccacacccatggcctcatccgtgagtacattgtagaatacagcaggagtggttccaagatgtgggcctcccagagggctgctagtaactttacagaaatcaagaacttattggtcaacactctatacaccgtcagagtggctgcggtgactagtcgtggaataggaaactggagcgattctaaatccattaccaccataaaaggaaaagtgatcccaccaccagatatccacattgacagctatggtgaaaattatctaagcttcaccctgaccatggagagtgatatcaaggtgaatggctatgtggtgaaccttttctgggcatttgacacccacaagcaagagaggagaactttgaacttccgaggaagcatattgtcacacaaagttggcaatctgacagctcatacatcctatgagatttctgcctgggccaagactgacttgggggatagccctctggcatttgagcatgttatgaccagaggggttcgcccacctgcacctagcctcaaggccaaagccatcaaccagactgcagtggaatgtacctggaccggcccccggaatgtggtttatggtattttctatgccacgtcctttcttgacctctatcgcaacccgaagagcttgactacttcactccacaacaagacggtcattgtcagtaaggatgagcagtatttgtttctggtccgtgtagtggtaccctaccaggggccatcctctgactacgttgtagtgaagatgatcccggacagcaggcttccaccccgtcacctgcatgtggttcatacgggcaaaacctccgtggtcatcaagtgggaatcaccgtatgactctcctgaccaggacttgttgtatgcagttgcagtcaaagatctcataagaaagactgacaggagctacaaagtaaaatcccgtaacagcactgtggaatacacccttaacaagttggagcctggcgggaaataccacatcattgtccaactggggaacatgagcaaagattccagcataaaaattaccacagtttcattatcagcacctgatgccttaaaaatcataacagaaaatgatcatgttcttctgttttggaaaagcctggctttaaaggaaaagcattttaatgaaagcaggggctatgagatacacatgtttgatagtgccatgaatatcacagcttaccttgggaatactactgacaatttctttaaaatttccaacctgaagatgggtcataattacacgttcaccgtccaagcaagatgcctttttggcaaccagatctgtggggagcctgccatcctgctgtacgatgagctggggtctggtgcagatgcatctgcaacgcaggctgccagatctacggatgttgctgctgtggtggtgcccatcttattcctgatactgctgagcctgggggtggggtttgccatcctgtacacgaagcaccggaggctgcagagcagcttcaccgccttcgccaacagccactacagctccaggctggggtccgcaatcttctcctctggggatgacctgggggaagatgatgaagatgcccctatgataactggattttcagatgacgtccccatggtgatagcctgaaagagctttcctcactagaaaccaaatggtgtaaatattttatttgataaagatagttgatggtttattttaaaagatgcactttgagttgcaatatgttatttttatatgggccaaaaacaaaaaacaaaaaaaaaaaaaaggaaagaaaggaatgaataaactttgtagtaatcaactgtgaacttcaaaccaggttgattttagtaacccaattgctttgatttgacattaatgtagtcttacagggctgtgcttgctgggcatgcttttacgtctgtgagataatttcggttcagtaaattggccaatctttttatttttctaagacacagaaatgtatttaataaaaacctcgagagagtgatgggtggaaccccttctccttgaaagtgtgtacagatattccattttgtttggatatagtttataggaaagtgtgtggatgtattatggcggaaggtttctttatgttattttgttaatttattgggactctgtgtaaggccaggctttagtggtcattagacaccacatgtgttatgagccccttacccatagggttgggggtgggaagagaagcatatttttttgccattccggaagcaatccatttttattcacttgtgtgtcatgtaatggtctttggcaggagagagcactgagtcattgctggagttcagttcaacagagctgcagcttgggaagccctgtaagcccacagcttcctctcttatattaattgatggaattttactgtatgtgcctctgtacaagatgtagctttgagagctacaaaatgataacactgctttattacacactggtttcattgtcattgcaaaaacttaccctggttgtgggggagagttctagatctgtgccatgatccatacactggctaatagagtacataatttttccattttccattttttgtttttacttactactgaaggatctcagatgtaaaattatgtatttggtttgagatggccacttattgtccttaaaaatccatactgatatatgcagtcattttgaattggacagtgccttctctttttttttctcctcttcttccatctccctcacccatgcccccacccaatctaaagagacagtgctgtacattctcatagagatagagaagatctaaaaagttgagactactcaatccagttaacaacagcaggagcactagagtttgttcatttattctctctgtaaaacaagctgtgctttttttcttctgcctttaaaatgccacccgtgtattcaaaccatggccacttgatacttatgtagaatccatcgtgggctgatgcaagccctttatttaggcttagtgttgtgggcaccaatgtcgagcatcgttgtgacttgtgctgtatgattctcactgaagaatttcctttcagccaagaagcagtgaggtctgggaatattccaaagtcatgtctctgaatatgtgtccttgacgtgcaagctttgtaaaaccccatccccgcttaggtgcgaggcatcaccttctcacaagtgtttagtttcttttaaccacaagtatcattcttgggtgataatatagtttcattctacttagggattgtttagaaaacaaagaaagagccaattaaattttttagtttttgaaatttttatttatatgtatacttagatgagtattttaagctgtcgacctttagtttgccatacgggtaggactgtatttcatgttaacaactggtggtaatgataagccttcttctagcgtattttctcttctttcctgtcactttcctaagtttttttttttaaagactggaattttttttggctttatcttgtcttaccgtagagatttgttcaaaactctaagccctaccacctcccctttaataagctctttaaatagttgaatcattaacaacctggtgggaggcaagtcatttaattgaaccactaggaagtgtattttcttttctttttctgccaactttttggtggcatttgtaaaagctgatataaaaggctctgagatgttattttcagttattccataggcaagcctttttacagagcatatgtctccagttggcagcttgagatatttccgagcatccggttctagctaccagtgcctcccaatgcttagtgcacagtactgtagactggccatcacccctctccttggaaaatgccactgtgctgtttgaaaaaaagcagccttttagggctagagtattttatataaacagaagagctaagttcctgaagactaagctagatagctgcagctatatgtaaattgtatatttttatgaacttttgaagcacacactcctgtttccctctgtgtagctttgtggggatttcatgtatatatgctgtctgaaagaatccagaggttggagtgccaatagaaaatgaaaacaaatgccttgtactacaggcagcctctgaaggtgaccacataactgtcttcactgtgaccaatcggagtccctgcttgcttgtgaagaaggggcttttgtaccttgttggagatgccacctcagaagttcacactgtgcaggaaaaaggttttattctctcctggcatacattagaatgtcagatgcttgcatccatgtggaccacgatgggcctctaaaaattggtgggcagggggtttgcttatgagttttctctggaaaccgattttactcctggatgtattgaatgccccttgagctttatgagatacgagtccacatggataaaatgttagagagtggagttctacagaggattccaggaagaggccatgtctgtgcagtcctagttccagacaggtgagaagctccaggaactactggctaccttgacaagctgggtaaatagttatcattctgggtaactggttgaaactctgacttttggacaagtaattcctggggttctgtctttggtagcatcaccagggatatttgggtgggacagacagaagacacacagctgcctgttctctcctgcccatcatgtttggcccactagatgaagctgtactcagcaatttagggaatgtaacccttctcagaactggccattttcaggggaagcttgggagagcaatagtatggtgagccccttagagatgagcgcctactccttcttggcgaatgctgccttcagatgcttaccaagtggtcactgcatctagtaagattatatttccagtacacttccttagggcagaaacaccatcctatcaggtttggtcagtcccttcttcatgaagggagtcatggggaattcctgaaaattttcttccttctgcagacagttggatgagtcccttagagaaggcatccagagacataactaaactgaatatcatcccatattgattttaggaattgactctaaaactctgtgcagaatcttgtgttgggattgtatcttgacattcctgttgtgttatttttcttaactggagtgtgtgctgcctttcaggtacaatttttgtgtaataaaagccagtgcattaagtttatatagactactttctatgcaagactgagatatggaatagataggaagagatatgtactgctgggtacatggacagtaagtgtgttttcagatggagtaccagcaccgaaaatgggttgagggaggatgggttgtatgtatgtttctgcccactaattttgagcagccatattatgaattaaatcgtcacagccaagtaataacccaagaatggtatgagtttcatgtgtaatagctcaaatggaataagcatgaatgctggagtggaccattatcctcaaatattctatgtcacttctcatttaaagactcttgttatgaactattagaaactttaggcaaaatcaaaagtatttgcggcaaaataaaggcctattctactcttatttaaagtgaaacactgtatacttgtttctctccaaagcgaaattaagtatttataatttcaattgcctcgataagtttccaagtcactgaaatctgctgaaggttttactgtattgttgcacaactttaagataatttttgtctcaatgtcaacttttttcactgaataaaaatttaactgggtcaagaaaaca

SEQ ID NO: 29496 - DNA, 3751 bp, Homo sapiens
ctcccgcgatgggaaaagttggcgccggcggcggctcccaagcccggctgagcgcgctcctcgccggcgcggggctcttgatcctctgcgccccgggcgtctgcggcggcggctcctgctgcccctcgccgcaccccagctccgctccacgctcggcctcgacccctaggggcttttcccaccaggggcggccaggcagggctcctgccacgcccctgcccctcgtagtgcgtcccctgttctcagtggcccccggggaccgagcgctatccctggagcgggctcggggcactggggcatccatggcggttgctgcacgctccggccggaggagacggagcggagcggatcaggagaaggcagaacggggagagggcgcgagtcggagcccccggggagtgctaagagatggagggcagcaggagcctgggactcgggagcgggacccggacaaagccacccgcttccggatggaggagctgagactgaccagcaccacgtttgcgctgacgggagactcagcacacaaccaagccatggtccactggtctggccacaacagcagcgtgattctcattttgacaaagctctatgactataacctggggagcatcacagagagctcgctttggaggtcaaccgattatggaacaacctatgagaagctgaatgataaagttggtttgaaaaccattttgagctatctctatgtgtgtcctaccaacaagcgtaagataatgttactcacagacccggagattgagagcagtttattgatcagctcagatgaaggggcaacttatcaaaagtaccggctgaacttctacattcaaagcttgctttttcaccccaaacaagaagactggattctggcatacagtcaagaccaaaagttatacagctctgctgaatttgggagaagatggcagcttatccaagaaggggttgtaccaaacaggttctactggtctgtgatggggtcaaataaagaaccagaccttgtgcatcttgaggccagaactgtggatggtcattcacattatctaacttgccgaatgcagaactgtacagaggccaacaggaatcagccttttccaggctacattgacccagactctttgattgttcaggatcattatgtgtttgttcagctgacatcaggagggcggccacattactacgtgtcctaccgaaggaatgcatttgcccaaatgaagcttccgaaatatgctttgcccaaggacatgcatgttatcagcaccgatgagaatcaggtgttcgcagcggtccaagaatggaaccagaatgacacgtacaacctctacatctcagacacacgtggtgtctacttcaccctggccttggagaatgtccagagcagcagaggccctgagggcaacatcatgatcgacctctatgaggtagcagggataaagggaatgttcttggctaacaagaagattgacaaccaagtgaagactttcatcacatataacaaaggcagagactggcgtttgctgcaggcgccggacacggatctaaggggggaccccgtgcactgcttgctgccctattgctcactacaccttcacctgaaggtctctgagaatccctacacatcagggatcattgccagcaaagacacagctccaagcatcatagtggcatcaggtaatataggttctgaattgtcagacactgacatcagcatgtttgtctcttcagatgcagggaacacctggagacagatctttgaagaagagcacagtgttttgtacctggatcaaggtggagtcctggttgctatgaaacacacatctctcccaattcgacatctttggttgagttttgatgaagggagatcttggagcaaatacagtttcacatctattccactttttgtggatggggttctgggtgagcctggagaagagactctcatcatgacagtgtttggacacttcagccaccgctctgaatggcagctggtcaaagtagattacaagtccatttttgatagacggtgtgccgaagaggactacagaccttggcagctgcacagccagggggaagcatgtatcatgggagcaaaaaggatatataagaagcgaaaatcagagcggaagtgtatgcaaggaaaatatgcaggagctatggaatctgaaccctgtgtctgcactgaggctgattttgattgcgactatggttatgagcgacacagcaatggccagtgcctgccggcattttggttcaatccatcctctctgtcaaaggattgcagcttgggacagagttacctcaatagtactgggtacaggaaggtggtttccaataattgcactgatggcgtaagggaacagtacactgccaaaccgcagaagtgcccagggaaagccccgcgggggctgcggatagtcacggctgatggaaagctgacagcggaacaaggacacaacgtcactctcatggtgcaattagaagagggtgatgttcagcggacactcatccaagtggactttggcgatggtatcgcggtgtcttacgtcaatctcagctccatggaagatgggatcaaacacgtctatcagaacgtgggcattttccgtgtgaccgtgcaggtggacaacagtctgggttctgacagcgccgtcctgtacttacatgtaacttgtcccttggagcacgtgcacctgtctcttccctttgtcaccacaaagaacaaagaggtcaatgcgacggcagtgctgtggcccagccaagtgggcaccctcacttacgtgtggtggtacggaaacaacacggagcctttgatcaccttggagggaagcatatccttcagatttacttcagaaggaatgaataccatcacagtgcaggtctcagctgggaatgccatcctacaagacacaaagaccatcgcagtatatgaggaattccggtctcttcgcttgtccttttctccaaacctggatgactacaacccggacatccctgagtggaggagggacatcggtcgagtcatcaaaaaatccctggtggaagccacaggggttccaggccagcacatcctggtggcggtgctccctggcttacccaccactgctgaactctttgtcctaccctatcaggatccagctggagaaaacaaaaggtcaactgatgacctggagcagatatcagaattgctgatccacacgctcaaccaaaactcagtacacttcgagctgaagccaggagtccgagtccttgtccatgctgctcacttaacagcggcccccctggtggacctcactccaacccacagtggatctgccatgctgatgctgctctcagtggtgtttgtggggctggcagtgttcgtcatctacaagtttaaaaggagagtagctttaccctcccctccctccccttctactcaacctggtgactcatctctccgattgcaaagagcaagacacgccactccgccttcaacgccaaagcggggatctgctggggcacagtatgcaatttaaggaaaacccccaaaggctacaggcgacctgctgatcaggaaagaatttcgctcttgtcaagtacatcatccttcatgaccactaactttgtgttttttttctttcctttgttgttctgtttcctattttgccaggaagtatttccatagttgctgagaatcaaagcacaaaagaaatccctacctatgtaaatgtttgaatggaggacgccagtaaaaaaacaaaaacaaaaacaa

SEQ ID NO: 29497 - DNA, 3612 bp, Homo sapiens
atgggaaaagttggcgccggcggcggctcccaagcccggctgagcgcgctcctcgccggcgcggggctcttgatcctctgcgccccgggcgtctgcggcggcggctcctgctgcccctcgccgcaccccagctccgctccacgctcggcctcgacccctaggggcttttcccaccaggggcggccaggcagggctcctgccacgcccctgcccctcgtagtgcgtcccctgttctcagtggcccccggggaccgagcgctatccctggagcgggctcggggcactggggcatccatggcggttgctgcacgctccggccggaggagacggagcggagcggatcaggagaaggcagaacggggagagggcgcgagtcggagcccccggggagtgctaagagatggagggcagcaggagcctgggactcgggagcgggacccggacaaagccacccgcttccggatggaggagctgagactgaccagcaccacgtttgcgctgacgggagactcagcacacaaccaagccatggtccactggtctggccacaacagcagcgtgattctcattttgacaaagctctatgactataacctggggagcatcacagagagctcgctttggaggtcaaccgattatggaacaacctatgagaagctgaatgataaagttggtttgaaaaccattttgagctatctctatgtgtgtcctaccaacaagcgtaagataatgttactcacagacccggagattgagagcagtttattgatcagctcagatgaaggggcaacttatcaaaagtaccggctgaacttctacattcaaagcttgctttttcaccccaaacaagaagactggattctggcatacagtcaagaccaaaagttatacagctctgctgaatttgggagaagatggcagcttatccaagaaggggttgtaccaaacaggttctactggtctgtgatggggtcaaataaagaaccagaccttgtgcatcttgaggccagaactgtggatggtcattcacattatctaacttgccgaatgcagaactgtacagaggccaacaggaatcagccttttccaggctacattgacccagactctttgattgttcaggatcattatgtgtttgttcagctgacatcaggagggcggccacattactacgtgtcctaccgaaggaatgcatttgcccaaatgaagcttccgaaatatgctttgcccaaggacatgcatgttatcagcaccgatgagaatcaggtgttcgcagcggtccaagaatggaaccagaatgacacgtacaacctctacatctcagacacacgtggtgtctacttcaccctggccttggagaatgtccagagcagcagaggccctgagggcaacatcatgatcgacctctatgaggtagcagggataaagggaatgttcttggctaacaagaagattgacaaccaagtgaagactttcatcacatataacaaaggcagagactggcgtttgctgcaggcgccggacacggatctaaggggggaccccgtgcactgcttgctgccctattgctcactacaccttcacctgaaggtctctgagaatccctacacatcagggatcattgccagcaaagacacagctccaagcatcatagtggcatcaggtaatataggttctgaattgtcagacactgacatcagcatgtttgtctcttcagatgcagggaacacctggagacagatctttgaagaagagcacagtgttttgtacctggatcaaggtggagtcctggttgctatgaaacacacatctctcccaattcgacatctttggttgagttttgatgaagggagatcttggagcaaatacagtttcacatctattccactttttgtggatggggttctgggtgagcctggagaagagactctcatcatgacagtgtttggacacttcagccaccgctctgaatggcagctggtcaaagtagattacaagtccatttttgatagacggtgtgccgaagaggactacagaccttggcagctgcacagccagggggaagcatgtatcatgggagcaaaaaggatatataagaagcgaaaatcagagcggaagtgtatgcaaggaaaatatgcaggagctatggaatctgaaccctgtgtctgcactgaggctgattttgattgcgactatggttatgagcgacacagcaatggccagtgcctgccggcattttggttcaatccatcctctctgtcaaaggattgcagcttgggacagagttacctcaatagtactgggtacaggaaggtggtttccaataattgcactgatggcgtaagggaacagtacactgccaaaccgcagaagtgcccagggaaagccccgcgggggctgcggatagtcacggctgatggaaagctgacagcggaacaaggacacaacgtcactctcatggtgcaattagaagagggtgatgttcagcggacactcatccaagtggactttggcgatggtatcgcggtgtcttacgtcaatctcagctccatggaagatgggatcaaacacgtctatcagaacgtgggcattttccgtgtgaccgtgcaggtggacaacagtctgggttctgacagcgccgtcctgtacttacatgtaacttgtcccttggagcacgtgcacctgtctcttccctttgtcaccacaaagaacaaagaggtcaatgcgacggcagtgctgtggcccagccaagtgggcaccctcacttacgtgtggtggtacggaaacaacacggagcctttgatcaccttggagggaagcatatccttcagatttacttcagaaggaatgaataccatcacagtgcaggtctcagctgggaatgccatcctacaagacacaaagaccatcgcagtatatgaggaattccggtctcttcgcttgtccttttctccaaacctggatgactacaacccggacatccctgagtggaggagggacatcggtcgagtcatcaaaaaatccctggtggaagccacaggggttccaggccagcacatcctggtggcggtgctccctggcttacccaccactgctgaactctttgtcctaccctatcaggatccagctggagaaaacaaaaggtcaactgatgacctggagcagatatcagaattgctgatccacacgctcaaccaaaactcagtacacttcgagctgaagccaggagtccgagtccttgtccatgctgctcacttaacagcggcccccctggtggacctcactccaacccacagtggatctgccatgctgatgctgctctcagtggtgtttgtggggctggcagtgttcgtcatctacaagtttaaaaggaagatcccggggattaatgtttatgcccagatgcagaatgagaaagaacaagagatgatcagtccagtcagtcactctgaaagcaggcccaatgtccctcagactgaactaaggaggcctggccagcttatagatgagaaggtggaatcccagctcataggaagtatttccatagttgctgagaatcaaagcacaaaagaaatccctacctatgtaaatgtttgaatggaggacgccagt

SEQ ID NO: 29498 - DNA, 2638 bp, Homo sapiens
gttcgcagcggtccaagaatggaaccagaatgacacgtacaacctctacatctcagacacacgtggtgtctacttcaccctggccttggagaatgtccagagcagcagaggccctgagggcaacatcatgatcgacctctatgaggtagcagggataaagggaatgttcttggctaacaagaagattgacaaccaagtgaagactttcatcacatataacaaaggcagagactggcgtttgctgcaggcgccggacacggatctaaggggggaccccgtgcactgcttgctgccctattgctcactacaccttcacctgaaggtctctgagaatccctacacatcagggatcattgccagcaaagacacagctccaagcatcatagtggcatcaggtaatataggttctgaattgtcagacactgacatcagcatgtttgtctcttcagatgcagggaacacctggagacagatctttgaagaagagcacagtgttttgtacctggatcaaggtggagtcctggttgctatgaaacacacatctctcccaattcgacatctttggttgagttttgatgaagggagatcttggagcaaatacagtttcacatctattccactttttgtggatggggttctgggtgagcctggagaagagactctcatcatgacagtgtttggacacttcagccaccgctctgaatggcagctggtcaaagtagattacaagtccatttttgatagacggtgtgccgaagaggactacagaccttggcagctgcacagccagggggaagcatgtatcatgggagcaaaaaggatatataagaagcgaaaatcagagcggaagtgtatgcaaggaaaatatgcaggagctatggaatctgaaccctgtgtctgcactgaggctgattttgattgcgactatggttatgagcgacacagcaatggccagtgcctgccggcattttggttcaatccatcctctctgtcaaaggattgcagcttgggacagagttacctcaatagtactgggtacaggaaggtggtttccaataattgcactgatggcgtaagggaacagtacactgccaaaccgcagaagtgcccagggaaagccccgcgggggctgcggatagtcacggctgatggaaagctgacagcggaacaaggacacaacgtcactctcatggtgcaattagaagagggtgatgttcagcggacactcatccaagtggactttggcgatggtatcgcggtgtcttacgtcaatctcagctccatggaagatgggatcaaacacgtctatcagaacgtgggcattttccgtgtgaccgtgcaggtggacaacagtctgggttctgacagcgccgtcctgtacttacatgtaacttgtcccttggagcacgtgcacctgtctcttccctttgtcaccacaaagaacaaagaggtcaatgcgacggcagtgctgtggcccagccaagtgggcaccctcacttacgtgtggtggtacggaaacaacacggagcctttgatcaccttggagggaagcatatccttcagatttacttcagaaggaatgaataccatcacagtgcaggtctcagctgggaatgccatcctacaagacacaaagaccatcgcagtatatgaggaattccggtctcttcgcttgtccttttctccaaacctggatgactacaacccggacatccctgagtggaggagggacatcggtcgagtcatcaaaaaatccctggtggaagccacaggggttccaggccagcacatcctggtggcggtgctccctggcttacccaccactgctgaactctttgtcctaccctatcaggatccagctggagaaaacaaaaggtcaactgatgacctggagcagatatcagaattgctgatccacacgctcaaccaaaactcagtacacttcgagctgaagccaggagtccgagtccttgtccatgctgctcacttaacagcggcccccctggtggacctcactccaacccacagtggatctgccatgctgatgctgctctcagtggtgtttgtggggctggcagtgttcgtcatctacaagtttaaaaggaagatcccggggattaatgtttatgcccagatgcagaatgagaaagaacaagagatgatcagtccagtcagtcactctgaaagcaggcccaatgtccctcagactgaactaaggaggcctggccagcttatagatgagaaggtggaatcccagctcataggagagtagctttaccctcccctccctccccttctactcaacctggtgactcatctctccgattgcaaagagcaagacacgccactccgccttcaacgccaaagcggggatctgctggggcacagtatgcaatttaaggaaaacccccaaaggctacaggcgacctgctgatcaggaaagaatttcgctcttgtcaagtacatcatccttcatgaccactaactttgtgttttttttctttcctttgttgttctgtttcctattttgccaggaagtatttccatagttgctgagaatcaaagcacaaaagaaatccctacctatgtaaatgtttgaatggaggacgccagtaaaaaaacaaaaacaaaaacaaaa

SEQ ID NO: 29499 - DNA, 663 bp, Homo sapiens
acctggatgactacaacccggacatccctgagtggaggagggacatcggtcgagtcatcaaaaaatccctggtggaagccacaggggttccaggccagcacatcctggtggcggtgctccctggcttacccaccactgctgaactctttgtcctaccctatcaggatccagctggagaaaacaaaaggtcaactgatgacctggagcagatatcagaattgctgatccacacgctcaaccaaaactcagtacacttcgagctgaagccaggagtccgagtccttgtccatgctgctcacttaacagcggcccccctggtggacctcactccaacccacagtggatctgccatgctgatgctgctctcagtggtgtttgtggggctggcagtgttcgtcatctacaagtttaaaaggaagatcccggggattaatgtttatgcccagatgcagaatgagaaagaacaagagatgatcagtccagtcagtcactctgaaagcaggcccaatgtccctcagactgaactaaggaggcctggccagcttatagatgagaaggtggaatcccagctcataggaagtatttccatagttgctgagaatcaaagcacaaaagaaatccctacctatgtaaatgtttgaatggaggacgccagtaaaaaaa

SEQ ID NO: 29500 - DNA, 3542 bp, Homo sapiens
agagcaggcagacagcagaatgaccaggcaccaagctctccattccactagcctctctgggccaggcctgtggagtctccagaggaaacaggcaggtgatcttgatcctgacgaagtactaccacgcagacatggggaaggttctggaaagttctctgtggcggtcatcagatttcgggacgtcctacaccaagctcaccctccagcctggtgtcaccaccgtcatcgacaatttctacatctgcccgaccaacaagaggaaggtcatccttgtcagctcctcactcagtgaccgggaccagagcctattcctcagcgcagacgaaggcgccacctttcagaagcagcccattcccttcttcgtggaaactctgattttccaccctaaggaggaggacaaggtcctcgcctacacaaaggagagcaagctctacgtgtcatctgacttggggaaaaagtggacacttctgcaagagcgagtgaccaaagaccacgtgttctggtctgtgtctggggtggacgctgaccctgacttggtccacgtggaagcccaagacctcggtggagattttcggtacgtcacctgcgcaatccacaattgctccgagaagatgctgacagccccattcgcaggccccattgaccacgggtctctgaccgtgcaggacgattacatcttctttaaggcaacatcagcaaaccagacaaaatactacgtctcttatcgtcgaaatgaatttgtcctgatgaagctgccgaagtatgcattgccaaaggatctgcagatcatcagcacggacgagagtcaggtgttcgtggcggtgcaggagtggtaccagatggacacctacaacctgtaccagtcggacccacggggcgtgcgctacgcgctggtgctgcaggacgtgcgcagctcacggcaggcggaggagagcgtgctcatcgacatcctggaggtcagaggggtgaaaggagtcttcctggcaaaccaaaaaattgatgggaaagtgatgacgcttataacctacaacaagggccgcgactgggattacctgaggccacccagcatggacatgaatggaaaaccaaccaactgcaagcctccagactgccacctgcacctgcacctgcgctgggcagacaacccctacgtatcaggcaccgtgcacaccaaggacaccgccccaggcctcatcatgggtgcaggtaacctgggctcacagctggtggaatataaagaagaaatgtacatcacgtcagactgtggtcacacctggcggcaggtgtttgaggaagagcatcacatcctgtacctggaccacggcggcgtgatcgtggccatcaaagacacctccatccctttgaagatcctcaagttcagtgtggacgagggcctcacctggagcacgcacaacttcaccagcacctcggtgtttgtggacgggctgctgagtgagccaggggacgagacgctggtcatgacggtctttggccacatcagcttccgctccgattgggagctggtcaaggtggacttccggccctcattctccaggcagtgcggcgaggaggactacagctcctgggagctctccaacctgcagggcgaccgctgtatcatgggccagcagagaagtttccggaaaagaaagtccacgtcctggtgcatcaaggggaggagcttcacgtcggcgctcacgtcccgcgtgtgcgagtgccgggactcggacttcctgtgcgactacggatttgagcgctcctcctcctcagagtccagcaccaacaagtgctctgccaacttctggtttaacccattgtccccgcctgacgactgtgccctgggccagacctacaccagcagccttgggtaccggaaagtggtgtccaacgtgtgtgagggtggggtggacatgcagcagagtcaggtgcagctgcagtgccccctcacgccgccccggggcctgcaggtcagcattcaaggcgaggcggtggccgtgcggcctggagaggacgtcctgtttgtggtgcggcaggagcagggtgatgtcctgactaccaagtaccaggtagaccttggggacggcttcaaggccatgtacgtgaaccttacactgaccggggagcccatccggcaccgctacgagagccccggcatctaccgcgtgtccgtcagggcagagaacacggcaggccacgatgaggcggtgctctttgtccaggtcaactcccccctgcaggccctctacctggaggtggttcctgtcattggcctcaaccaggaggtgaacctcacagctgtgctgcttcccttgaaccctaacctcaccgtcttctactggtggatcggccacagcctgcagcccctcctttccctggataattctgtgacaacgcggttttcggacacgggcgacgtgcgtgtgacggtgcaggccgcctgtgggaactcggtgctgcaggactccagggtcctccgtgtgctggatcaatttcaagtcatgcctctgcagttttccaaggagctggatgcctacaaccccaacacccctgagtggagggaagacgtgggcctggtggtcacccggctgctctccaaggagaccagcgtccctcaggagcttctggtgactgtggtgaagccggggctgcccactttggccgatctgtacgtgctcctgccccctcccaggcccacaaggaagaggagcctctcgagtgataagaggctcgccgccatccagcaggtgctgaacgcacagaagatcagcttcctcctgcgaggcggagtccgggtcctggtggccctgcgggacacaggcacaggtgctgagcagctgggcggcggtggcggctactgggcggtagtggtgctgtttgtcatcgggctcttcgcagcgggagccttcatcctctacaagttcaaaagcaggaaacggccaggcaggaccgtgtacgcccaaatgcacaacgagaaggagcaggagatgaccagccctgtgagtcacagtgaggacgtccagggcgctgtccagggtgaggagtttatagatgatgatctcgactcgcagactctaggcaaccactcaggcgtggtcctgagcatcaactcccgagagatgcacagctacctggtgagctgatgccaccccagcatctgtcttttcacccacggagggcacagaaccaccagcaaagccggcggctggactggcgcccctcagagacctgcggaaagccccctccctgagtcgtcgccacaccaggcgacaggcaccaccccctctgataaatccaagcccgcccaggcccacggggggcccacgggaccccccgggactccccggacatggccctgcccctatgggacaccaggcctgactcaggcaggttctgccccccagaccccacacacggccgccccacgtgctgtcgctcagcccgaggcctgacttctctgggctgaggctggtcgtcctggagccctcccagtacctcgggctgcaagagctgcagacccgttcagacactgcgttgcgggctcc

SEQ ID NO: 29501 - DNA, 6152 bp, Homo sapiens
cctttctctgcgctctcgctcgcgctccccagcgccctcctgctctcccggccgcggtcccctcgtccgcgccgccccgccgccggctccgctgccgcccctggcgaccatggcgcaccgggggccctcgcgcgcctcgaagggccccggccccaccgcccgagccccgagccccggggctccgccgccgccgcgctcgccgcgctcgcggccgctcctgctgctgctgctgctgctgggcgcctgcggggcggcggggcgctcccctgagcccgggcgcctgggtcctcacgcccaactgacccgggtgccgcggagccctcccgcggggcgcgcggagcccggtggcggcgaggaccggcaggcgcgcggcacggagccaggcgccccgggtccgagtcccggtcccgctcctggtcccggcgaggacggcgcccccgccgcgggctaccggcgctgggagcgggcggcgccgctggccggagtggcttcgcgggcgcaggtctcgctcatcagcacgtcgttcgtgctcaagggggacgcgacgcacaaccaggcgatggtgcactggacgggcgagaacagcagcgtgatcttgatcctgacgaagtactaccacgcagacatggggaaggttctggaaagttctctgtggcggtcatcagatttcgggacgtcctacaccaagctcaccctccagcctggtgtcaccaccgtcatcgacaatttctacatctgcccgaccaacaagaggaaggtcatccttgtcagctcctcactcagtgaccgggaccagagcctattcctcagcgcagacgaaggcgccacctttcagaagcagcccattcccttcttcgtggaaactctgattttccaccctaaggaggaggacaaggtcctcgcctacacaaaggagagcaagctctacgtgtcatctgacttggggaaaaagtggacacttctgcaagagcgagtgaccaaagaccacgtgttctggtctgtgtctggggtggacgctgaccctgacttggtccacgtggaagcccaagacctcggtggagattttcggtacgtcacctgcgcaatccacaattgctccgagaagatgctgacagccccattcgcaggccccattgaccacgggtctctgaccgtgcaggacgattacatcttctttaaggcaacatcagcaaaccagacaaaatactacgtctcttatcgtcgaaatgaatttgtcctgatgaagctgccgaagtatgcattgccaaaggatctgcagatcatcagcacggacgagagtcaggtgttcgtggcggtgcaggagtggtaccagatggacacctacaacctgtaccagtcggacccacggggcgtgcgctacgcgctggtgctgcaggacgtgcgcagctcacggcaggcggaggagagcgtgctcatcgacatcctggaggtcagaggggtgaaaggagtcttcctggcaaaccaaaaaattgatgggaaagtgatgacgcttataacctacaacaagggccgcgactgggattacctgaggccacccagcatggacatgaatggaaaaccaaccaactgcaagcctccagactgccacctgcacctgcacctgcgctgggcagacaacccctacgtatcaggcaccgtgcacaccaaggacaccgccccaggcctcatcatgggtgcaggtaacctgggctcacagctggtggaatataaagaagaaatgtacatcacgtcagactgtggtcacacctggcggcaggtgtttgaggaagagcatcacatcctgtacctggaccacggcggcgtgatcgtggccatcaaagacacctccatccctttgaagatcctcaagttcagtgtggacgagggcctcacctggagcacgcacaacttcaccagcacctcggtgtttgtggacgggctgctgagtgagccaggggacgagacgctggtcatgacggtctttggccacatcagcttccgctccgattgggagctggtcaaggtggacttccggccctcattctccaggcagtgcggcgaggaggactacagctcctgggagctctccaacctgcagggcgaccgctgtatcatgggccagcagagaagtttccggaaaagaaagtccacgtcctggtgcatcaaggggaggagcttcacgtcggcgctcacgtcccgcgtgtgcgagtgccgggactcggacttcctgtgcgactacggatttgagcgctcctcctcctcagagtccagcaccaacaagtgctctgccaacttctggtttaacccattgtccccgcctgacgactgtgccctgggccagacctacaccagcagccttgggtaccggaaagtggtgtccaacgtgtgtgagggtggggtggacatgcagcagagtcaggtgcagctgcagtgccccctcacgccgccccggggcctgcaggtcagcattcaaggcgaggcggtggccgtgcggcctggagaggacgtcctgtttgtggtgcggcaggagcagggtgatgtcctgactaccaagtaccaggtagaccttggggacggcttcaaggccatgtacgtgaaccttacactgaccggggagcccatccggcaccgctacgagagccccggcatctaccgcgtgtccgtcagggcagagaacacggcaggccacgatgaggcggtgctctttgtccaggtcaactcccccctgcaggccctctacctggaggtggttcctgtcattggcctcaaccaggaggtgaacctcacagctgtgctgcttcccttgaaccctaacctcaccgtcttctactggtggatcggccacagcctgcagcccctcctttccctggataattctgtgacaacgcggttttcggacacgggcgacgtgcgtgtgacggtgcaggccgcctgtgggaactcggtgctgcaggactccagggtcctccgtgtgctggatcaatttcaagtcatgcctctgcagttttccaaggagctggatgcctacaaccccaacacccctgagtggagggaagacgtgggcctggtggtcacccggctgctctccaaggagaccagcgtccctcaggagcttctggtgactgtggtgaagccggggctgcccactttggccgatctgtacgtgctcctgccccctcccaggcccacaaggaagaggagcctctcgagtgataagaggctcgccgccatccagcaggtgctgaacgcacagaagatcagcttcctcctgcgaggcggagtccgggtcctggtggccctgcgggacacaggcacaggtgctgagcagctgggcggcggtggcggctactgggcggtagtggtgctgtttgtcatcgggctcttcgcagcgggagccttcatcctctacaagttcaaaaggaaacggccaggcaggaccgtgtacgcccaaatgcacaacgagaaggagcaggagatgaccagccctgtgagtcacagtgaggacgtccagggcgctgtccagggcaaccactcaggcgtggtcctgagcatcaactcccgagagatgcacagctacctggtgagctgatgccaccccagcatctgtcttttcacccacggagggcacagaaccaccagcaaagccggcggctggactggcgcccctcagagacctgcggaaagccccctccctgagtcgtcgccacaccaggcgacaggcaccaccccctctgataaatccaagcccgcccaggcccacggggggcccacgggaccccccgggactccccggacatggccctgcccctatgggacaccaggcctgactcaggcaggttctgccccccagaccccacacacggccgccccacgtgctgtcgctcagcccgaggcctgacttctctgggctgaggctggtcgtcctggagccctcccagtacctcgggctgcaagagctgcagacccgttcagacactgcgttgcgggctccttccccgcagaggccggggcctccctgactttgcttcttcactcccacctgtgcggccacccagtccctctgtgggagcccgggtgccaggccctcccaacaccacaccaccctccaggcccccctgccctccggctggaaactgcagctctgtaaatgcctctctaggtagctgctggcggtggtgggggtgtctcactctctgtctttatagccggcggtagccaccggggtggctctgtcagagttccgtactcgggagcccctttccctgagtgcccagggtgtctcctctgcccagaggggcagcagctctccctggttctccccagggcagacggggtagggcgggctcaggacccagtgcccatggttcctcactcctaccagcaagcagcaccatcccgcaggcttctcccacctgatggctgttctcccaccgggtctgggctctggaaggagccagatgcccccagaaaggtgggtggtggagacggcaccagatgtaccagttttctgcagttccttataggcgaagggaaccgggtggaaaccaagctgggagaggctgaggatggcagggctggaagggccatcagcgtgaccctcattttcaagaaggggaaactgaggcccagggaggagagtaactgaaggtcacagcacggtcacagcagaggtggccgaacccagccctctgcgcgccagtgctgtgcggtctccacacccttacggtttcctagaatcagggatgttagtgtaagtctataggaatataggggggtgggggggtcaccttttgccttgaaatgggaagtcagtagccccttcctcctcctccctcctccccctcctctctggcagggatctcagatgaccgtggcctccctctcagagggggagaacgccagagccctggctggtgatgtgctggctgggggtgaatcccaatgagggtccctctcagagcgggagaacgccagagccctggatggtgatgcgctggctgggggtgaatcccaatgagggtccctctcagaaagggagaacgccagagccctggctggtgacatgctggctgggggtgaatccgaatgacagtgcagacgttctcccatccaccatgtctgagcttgggggaattgcctcatttcccctggaaaagaaacatggtccattagaggggaaagcccaggggtgaatcttcacgccccaaacagtgcccggtggggaggaggcacccgctccttgttgagtaaaaccacccatggagactggaacctcatctccctgggtcggggggtgttcaaggccacaggacaaggggagcaccctgggccacacaggcgtggaggtgtccccaccccttccacctgtcccccagacccaaagctctctccccaccctacctgcccacctggggctcctgtgccccctccccactccagaggccaccctacaagttgtcctcaaggtcatcctggagatgggatccaggacgtggggccatgactctctgggaccttgccacagcccccattcccctgcttgcagtctgcaaggacacctttgcagggattcttgtcctgctggccaccccacccacacctgtccctggccagcaggccgcctgcaagcgtcaggcacacagggacagacatggcgagcacagtgcaggcccggggcccacgggcaacatggaaccctgggaactgccctcccccttagctcacagtgcctgcggtagccactctaggtcgttggccttccttgaccactccatttaattctctctgctgtttgggttgggtttttccccttagttatctgtgggtttcctgtattttatgttaatatttctattaagaacatgttgggcatgtggacccaagcacctgggaaggaggtggcatctgagacagcctgatacgttcccgtctgtgcacccatggagatccaggcgtgggcccgtgtctgtccctggttgtaaattcgagggtctgcatatctgatgttcaggtagacctgggcgcctgggaacgaggccatcagctgccatgcacataacaaagagacaatgcattccttcttatttttcctttttaaaaatcgatgaatcatttgtgatgcttttaacaaagattaaatgaatttgatcagc

SEQ ID NO: 29502 - DNA, 1522 bp, Homo sapiens
attctgagtacttgaaacgtgacattccatccactaagccctcctgcttgggctgtttgtcgattctaatgtgttgaaatatatctgcaactctaggtgctgtctccgcccaagtccagaaatgcagttttgatcaaatctcataataatatggggagatgttgaagattaaaacctattgataatccacactgccagaaagcaagatacagaggaaaatttaataacctgaaaaacggttacagaagagtgtggctttattttcagctgtcttttttgtgtacttgtttccaacacaggagtttttggccacttcagcctccgctccgaatggcaattggtgaaagtggactacaaatctatcttcagccggcattgcaccaaggaggactatcagacctggcacctgctcaatcagggagagccttgtgtcatgggagaaaggaaaatattcaagaaacgtaagccaggagctcagtgtgccctgggccgagaccactcaggatcagtggtctcagaaccctgtgtctgtgccaattgggacttcgagtgtgactatgggtatgagagacatggggagagccagtgtgtcccagctttctggtacaatccagcatccccatcaaaggactgcagccttggtcaaagctaccttaacagcactgggtatcggcggattgtgtccaacaactgcacagatgggctaagggagaagtacaccgccaaggcccagatgtgccctggaaaagcccctcggggcctccatgtggtgacgaccgatgggcggctggtggcagagcaggggcacaatgcaactttcatcatcctcatggaggagggtgatctacaaaggacaaacatccagcttgactttggggatgggattgctgtgtcctacgcaaacttcagccccatcgaggacggcatcaagcacgtgtataagagtgcggggatcttccaggtgacagcctatgcagagaacaaccttggctcagacacagctgtcctcttcctgcatgtggtttgatgtcgggtcgaggaaatgttgtcttggggctgggattggtttcccacatgtgtatcagtgatattcgtgggtctaaggacttccatggttcttacttacataccccacaagagtttccaggtcctgtggagcatgttcatctccgagttccatttgttgccataagaaataaggaggtcaacatcagtgcagtcgtgtggcccagtcaactggggacccttacctatttctggtggttcggcaatagcacaaagcctctcatcactttggacagcagcatttccttcacattccttgcagaaggaaccgacaccatcacagtccaggtggctgctgggaatgccctcatccaggacacaaaagagattgcagttcatgaatatttccagtcccagcttttatcattctctcctaatctggattaccacaatcctgacattcctgagtggagaaaagatattggcaatgtcatcaagcgagctctggttaaagtaa

SEQ ID NO: 29503 - DNA, 5757 bp, Homo sapiens
atcaccctctggacaagagaacgggcgagcgggagctaggagggaagagtggagaggaccggcgaggcgcgccagccggagccacctccttcccggccgccccctccccactccccctacacacacacgctcgctcgctcgccggcgcgcgcacaccccccgcgccggacccgcacctcggcgggcgccacacactcggcagcccgagccgcggtagccgcagcgggatggaggcggcgcgcacggagcgccccgcaggcaggccgggggcgccgcttgtccggacggggctcctactcttgtcgacgtgggtcctggccggcgccgagatcacttgggacgcgacaggcggtcccggacgcccggcggccccggcttcgcggccaccggcgttgtctccactctcgccgcgggcagtggccagccagtggccggaggagctggcgtcggcgcggagagccgccgtgctggggcgccgggccggaccagagctgctgccccagcagggcggcggcagaggcggtgagatgcaggtggaagccggagggacatcaccggcaggcgagcggcggggccggggcatcccagctcctgccaagcttggcggcgcgaggaggagtcgccgggcgcagcccccaatcacccaggaacgcggggacgcctgggccactgctccggccgatggttccagaggaagccgtccccttgctaagggttcccgggaggaggtgaaggcgccgcgggctggggggtcggcggctgaagacctccggctgcccagcacctccttcgcgctgaccggggactcggcccacaaccaagccatggtgcactggtcgggacacaacagcagcgtcatacttatcctgacgaagctgtatgacttcaacctgggcagcgtgactgagagttcactatggaggtcgacagattatggcaccacctatgaaaagctgaatgacaaagtgggtttgaagactgtcctcagttacctctatgtcaatccaaccaacaaaaggaagattatgcttctcagtgatcctgagatggagagcagcatattgatcagctcagacgaaggggcgacctatcagaagtatcggctcaccttctatatccagagcctgctctttcatcccaagcaagaggactgggtgctggcctacagtttggatcaaaagctctacagctccatggactttggaagacggtggcaactcatgcatgaacgcatcacacccaacaggttttattggtcggtggccggattggataaggaggcggacctggtgcacatggaggtgcggaccacggatggatatgctcactacctcacctgcaggatccaggaatgtgccgagacaactagaagtgggccttttgcccgctccattgacatcagttccctggttgtccaggatgaatatatcttcattcaggtaacaactagtggaagagccagctactacgtgtcttatcgaagagaggcctttgctcagataaagctgcctaagtactcgttgccaaaggacatgcacatcatcagtacagacgagaaccaagtatttgctgcggtccaagaatggaaccagaacgacacgtacaacctctacatctcagacacgcgtgggatttacttcactctggccatggagaacatcaagagcagcagaggtctaatggggaacatcattattgaattgtatgaggtagcaggtatcaaagggatatttctggcaaacaagaaggtggacgaccaggtgaagacatacatcacttacaacaaaggcagggattggcgcctgctgcaagctccggatgtggacctgagaggaagcccagtgcactgcctgctgcccttctgttccttacatctgcacctgcaactctctgaaaatccatattcctcaggaagaatctctagcaaggagacagccccaggacttgtggtggctacaggcaacattggcccggagctctcatatactgatattggtgtgttcatctcctccgatgggggcaacacatggagacagatctttgatgaagagtacaatgtctggttcctagactggggtggtgccctcgtggccatgaaacacacacctctgccagtcaggcatttgtgggtgagttttgatgagggccactcttgggacaagtatggtttcacttcggttcctctctttgttgacggggctctggtggaggcaggaatggagacccacatcatgacagtttttggccacttcagcctccgctccgaatggcaattggtgaaagtggactacaaatctatcttcagccggcattgcaccaaggaggactatcagacctggcacctgctcaatcagggagagccttgtgtcatgggagaaaggaaaatattcaagaaacgtaagccaggagctcagtgtgccctgggccgagaccactcaggatcagtggtctcagaaccctgtgtctgtgccaattgggacttcgagtgtgactatgggtatgagagacatggggagagccagtgtgtcccagctttctggtacaatccagcatccccatcaaaggactgcagccttggtcaaagctaccttaacagcactgggtatcggcggattgtgtccaacaactgcacagatgggctaagggagaagtacaccgccaaggcccagatgtgccctggaaaagcccctcggggcctccatgtggtgacgaccgatgggcggctggtggcagagcaggggcacaatgcaactttcatcatcctcatggaggagggtgatctacaaaggacaaacatccagcttgactttggggatgggattgctgtgtcctacgcaaacttcagccccatcgaggacggcatcaagcacgtgtataagagtgcggggatcttccaggtgacagcctatgcagagaacaaccttggctcagacacagctgtcctcttcctgcatgtggtttgtcctgtggagcatgttcatctccgagttccatttgttgccataagaaataaggaggtcaacatcagtgcagtcgtgtggcccagtcaactggggacccttacctatttctggtggttcggcaatagcacaaagcctctcatcactttggacagcagcatttccttcacattccttgcagaaggaaccgacaccatcacagtccaggtggctgctgggaatgccctcatccaggacacaaaagagattgcagttcatgaatatttccagtcccagcttttatcattctctcctaatctggattaccacaatcctgacattcctgagtggagaaaagatattggcaatgtcatcaagcgagctctggttaaagtaaccagtgtcccagaggaccagatcctcattgccgtgtttcctggtctccccacttcagcagagcttttcattcttccacccaagaacctgacagagaggaggaaaggcaatgaaggggacctggaacaaattgtagaaacactgtttaatgctctcaaccaaaatttggtccagtttgagctgaagccgggggtacaagtcattgtgtatgtcacacagctgacgttagctccattggtggactccagtgctgggcacagcagctcagccatgcttatgctattatcagtggtatttgttggcctggctgtgtttttgatctacaagtttaaaaggaaaatcccttggattaacatctatgctcaagtccaacacgacaaggagcaggagatgattgggtcagtgagccaaagtgaaaacgcccccaaaatcacactcagtgactttacggagcctgaggagctgctggacaaagagctggacacgcgggtcataggaggcattgccactattgcaaacagcgaaagcacaaaggagatccccaactgcactagtgtttaataccagcaagccacgtggtcaaccacctttctgactttttatttttgatgattactattactattattatggaaaaattaaaatgtcttttttaccttttgtttaccaagggccccttcataaatagcaggcaaatgcctagctttgggagaaaagggcattcttagctgattgaaatgagacaaagggaataaatggctgtatttgtgctaagagcaaaggatgcatcttcccacagcctcctcgctttactctgccattggtagcttaaagactttctttttccttgtggtctcccttttttcaaaattgaagttgggttggctctttgtgaacctctcatccccacagcagaatcaccaacactctccgcttcccccagcacacacacatacaacacagatcatttcccagttagatccgcaggaagtaggttggtgggggtggatgtagctgcagaaagcatgcacaactttgtgaaagaggccctgccttgtgcatgtccatagtgaggctacagatggcttattgtatataattacaatgtaaatagctttttatttcctaagaaataatttaatgtttagtaaaaaagaaaacagaaaaaagaaagatgcgtgtgttggcttacgcactggccctcagagctgaccaacccgccaggcctgctcaatgcattgggtttggatgctctcctgttgtctgtcacacttaactcttgcatctccttgtccatgccatagctggtttctacttatgtatataaaggggggtggggggaggggcttctctggggcaattgataaaggaaggactctagtgacatcatagaacatggcagtcgtttttgttccaagaatgatatgaaaggtgaagaagaggcccactagaggcttcatactgagacccagatgggggaaaacagcttcctctctaaaaggaaaaacttgatatttatcagtctgagaaaatatttttttctaaagaaggcagtcagtggatcttaaaatgacaatctgtttttaaattggattctatgaaaatgcataatgcttatggtgaattctcaggctattctgagctcagaaaagtcccctgggcactaggtaaagcccagtgaatgtctcttggcatgggaggagttaaagaggttggaagggaagaggcatttgtggaattatgagttcatgcaaaactctccaggccaagtaggggtctagcctttaatgatattagtcaaaggcaattttagcaaagctgtgctatttgcttgtcagatgtacacaacttccttaaagtcaaatgtctgccttcagttcccttaaggtagttcttgcctctggggtgagtggctttcaaagccttttagcttttccagcacctcagccccttcacacatttacacataccaatttttttcaatagggtcacgttaagccatgctgtaagcattgtttttattttcaggcttagcctgagcacacttatttttgaaaatgatataatgtatatatatgggaggaaaggccacattttgtacctgttaatttttgtgggatgttgttcccattcttctttgtgagacagagagaatgtgatatagagaaatctggctggctacagtgtagatcagtattaggaatatttctaaagatcctgcttttttgtttcaagggttaaatggggcagacaattgcaatacttgtactaaacactggaatacaaatgcatgactcatatctatatatacagtatatgtacatatactgttcttggttttattgttccacttgaatatttctactgtaaaaaaaagacagtggttttgaaattgttgaaaataaatgtatttttgtacatc

SEQ ID NO: 29504 - DNA, 458 bp, Homo sapiens
gaaaatccatattcctcaggaagaatctctagcaaggagacagccccaggacttgtggtggctacaggcaacattggcccggagctctcatatactgatattggtgtgttcatctcctccgatgggggcaacacatggagacagatctttgatgaagagtacaatgtctggttcctagactggggtggtgccctcgtggccatgaaacacacacctctgccagtcaggcatttgtgggtgagttttgatgagggccactcttgggacaagtatggtttcacttcggttcctctctttgttgacggggctctggtggaggcaggaatggagacccacatcatgactgactatgggtatgagagacatggggagagccagtgtgtcccagctttctggtacaatccagcatccccatcaaaggactgcagccttggtcaaagctaccttaacagcactgg

SEQ ID NO: 29505 - DNA, 1717 bp, Homo sapiens
cggggaatcatggccgcccccagtgttccgcgtccgggggtttgtgggagttgccttgacctgcagctccgccaccgcggacccgccttctgccctcagcagcagacgctctgtcccgcccgggcagctctgcgaggcagcggctggagagggaaccatggggactgtgcacgcccggagtttggagcctcttccatcaagtggacctgattttggaggattaggagaagaagctgaatttgttgaagttgagcctgaagctaaacaggaaattcttgaaaacaaagatgtggttgttcaacatgttcattttgatggacttggaaggactaaagatgatatcatcatttgtgaaattggagatgttttcaaggccaaaaacctaattgaggtaatgcggaaatctcatgaagcccgtgaaaaattgctccgtcttggaatttttagacaagtggatgttttgattgacacatgtcaaggtgatgacgcacttccaaatgggttagacgttacctttgaagtaactgaattgaggagattaacgggcagttataacaccatggttggaaacaatgaaggcagtatggtacttggcctcaagcttcctaatcttcttggtcgtgcagaaaaggtgacctttcagttttcctatggaacaaaagaaacttcgtatggcctgtccttcttcaaaccacggcccggaaacttcgaaagaaatttctctgtaaacttatataaagttactggacagttcccttggagctcactgcgggagacggacagaggaatgtcagctgagtacagttttcccatatggaagaccagccacactgtcaagtgggaaggcgtatggcgagaactgggctgcctctcaaggacggcgtcatttgctgttcgaaaagaaagcggacattcactgaaatcatctctttcgcacgccatggtcatcgattctcggaattcttccatcttaccaaggagaggtgctttgctgaaagttaaccaggaactggcaggctacactggcggggatgtgagcttcatcaaagaagattttgaacttcagttgaacaagcaactcatatttgattcagttttttcagcgtctttctggggcggaatgttggtacccattggtgataagccgtcaagcattgctgataggttttaccttgggggacccacaagcatccgcggattcagcatgcacagcatcgggccacagagcgaaggagactacctaggtggagaagcgtactgggccggcggcctgcacctctacaccccattacctttccggccaggccagggtggctttggagaacttttccgaacacacttctttctcaacgcaggaaacctctgcaacctcaactatggggagggccccaaagctcatattcgtaagctggctgagtgcatccgctggtcgtacggggccgggattgtcctcaggcttggcaacatcgctcggttggaacttaattactgcgtccccatgggagtacagacaggcgacaggatatgtgatggcgtccagtttggagctgggataaggttcctgtagccgacacccctacaggagaagctctgggactggggcagcagcaaggcgcccatgccacacaccgtctctcgaggaaacgcggttcagcgattctttgactgcggaccctgtgggaaaccccgtcaataaatgttaaagacacactccgag

SEQ ID NO: 29506 - DNA, 1432 bp, Homo sapiens
agctctgcgaggcagcggctggagagggaaccatggggactgtgcacgcccggagtttggagcctcttccatcaagtggacctgattttggaggattaggagaagaagctgaatttgttgaagttgagcctgaagctaaacaggaaattcttgaaaacaaagatgtggttgttcaacatgttcattttgatggacttggaaggactaaagatgatatcatcatttgtgaaattggagatgttttcaaggccaaaaacctaattgaggtaatgcggaaatctcatgaagcccgtgaaaaattgctccgtcttggaatttttagacaagtggatgttttgattgacacatgtcaaggtgacctttcagttttcctatggaacaaaagaaacttcgtatggcctgtccttcttcaaaccacggcccggaaacttcgaaagaaatttctctgtaaacttatataaagttactggacagttcccttggagctcactgcgggagacggacagaggaatgtcagctgagtacagttttcccatatggaagaccagccacactgtcaagtgggaaggcgtatggcgagaactgggctgcctctcaaggacggcgtcatttgctgttcgaaaagaaagcggacattcactgaaatcatctctttcgcacgccatggtcatcgattctcggaattcttccatcttaccaaggagaggtgctttgctgaaagttaaccaggaactggcaggctacactggcggggatgtgagcttcatcaaagaagattttgaacttcagttgaacaagcaactcatatttgattcagttttttcagcgtctttctggggcggaatgttggtacccattggtgataagccgtcaagcattgctgataggttttaccttgggggacccacaagcatccgcggattcagcatgcacagcatcgggccacagagcgaaggagactacctaggtggagaagcgtactgggccggcggcctgcacctctacaccccattacctttccggccaggccagggtggctttggagaacttttccgaacacacttctttctcaacgcaggaaacctctgcaacctcaactatggggagggccccaaagctcatattcgtaagctggctgagtgcatccgctggtcgtacggggccgggattgtcctcaggcttggcaacatcgctcggttggaacttaattactgcgtccccatgggagtacagacaggcgacaggatatgtgatggcgtccagtttggagctgggataaggttcctgtagccgacacccctacaggagaagctctgggactggggcagcagcaaggcgcccatgccacacaccgtctctcgaggaaacgcggttcagcgattctttgactgcggaccctgtgggaaaccccgtcaataaatgttaaagacac

SEQ ID NO: 29507 - DNA, 8077 bp, Homo sapiens
agttgttgttgcggcttccgccgcgggtggaagaagatggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcagatgccacagtggagctatccttggacagcacacaaaataatcagaagaaggtgctagccaaaacactcatttctcttcctcctcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccgcccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgctgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcaggtcacatgactcagaatgttggtggtttttgcttaggctggggagcagttgggaatcaggtctggaatactcctaaccaagaagttgcccaggtatagtaagtttttctctaccgttcacaagttttgtgctgctgcttccctctggaaatggggtttctttctctccgcctacctcagctacctgttctgagggtctcaatctgtttcgtattcccacttctttagggaaggagttttaaaaacatctcttaaaataagaggagcaaaatctattaaaacctattctcctgcaaaggaggcagagactttctctctctcttttttttttttttttggtgtccctatcattaagcaagagcctttctcttttattcttcctgcttccctaagctgctcagggttctctgagtcttgccctctgatggcaagtcttatatataactaaacctatttttgtcacccatcaaaacacatcctcagtagactgtgtgaaggtgtgaaggtctgataatgacttgatgctttgtctccatagacatgaaagccatgccctctgcctctagatagggtgatccaagagctcctgaaccttaggaggttcaaagaagctctactgtctgtgcccaggaggtagcctgccagcaagagccctcaggagttgcacacacagccaaagggtgttcacacagatctctgccggtctagccaggggaggccagagtctcgtcagtcaaggatgggcttcccccttagctgtgtccacagctgctcaagctatactggtcagagtgggctttgaagctcctttgtgagctcgagctgctgactgccactatgggagccttgccacctccagcccctccatcccaaagacgctcctgccactggggccccaggtcctgctgtatcagttctctttggtggggggctaaggtttggggcgaggcaacctgagacaagaaaacgcagtaaacattctgattccctgtacacagatgcagcaccaggggaagggccagtggtgcaagtatttctttttaacaggtgaagtttttggaaaaagtcactctccctacccctcagtatccttaccatcaactttggttttatccttccagtctttattatatgcttgcttttacatagttgtaataatatacacataaagtattttgtatcctgcttttatcattcaacattgtacatgttataagcattttactatattgttatatatcttcacaaagttgatctgtaaagctgtgtaatttgaaggcatccatagggtgactgtaccataattttgattcatcccttgttgttggattcttggtcaggggttgtttgttttgttttattggtaactttaaaattttgaatacaatttcagatttacagaaaagttgcaggaatatcacaaagaactcctatatatcttttatccagatttactgagtgtttacattttatcccatttgccttatctatatttcatgttgcattttcttaatcatttgagaataatttgcacagataccccattatgcccaaaacagtatgcatttccctaagaacaggacattctcttctaagagaagaagagaattactttaagcattattcagtatttttttaagtattattatcaaaatcaggaagtttaacagtgatttaatactgttatctaacccatgattcatatttaaattttgccatttatcccaataatgtcctttgtagccattcttttaccttgtgcaggatcatgttacatttgtaaacgtgtgtctctcaatactgcagattcctcaactttcttttgtctttcattaccatgacatttttgaagaatacaggctattttgtcgaatgttcctcagtttggatttgtgtgatggttccgcatgactaggtgagggttttgcattctgggtgggaatatcacagaagcagtgtgtcgtcagtgcgtcgtaatcagcatataatgtcagttggtcccattaatgttgttaactctgttcaccgcttaggttggtgtctgccagatttcattttaaatttacgatttcctctttgtaatttacaagtaatttgtggggagatactttgagactatataagtattttgttcctcattcaccagttatatagtatcagttgattagtcttgtcccagttattactgtcatgattgaccaacatgatttcctaactccataatgccttctacatttattggttgacattctacatacaaagaaaaacatcctttctcaccatttatttattcacttgtttatcaatatggatgcagggattcctgttttactcagagttgcaagccattgctttgattttatcttgattctcaaattgtcccagatttatagcggcctcttgtgtgtttgtagcttgctcccatcatgttttgagtactttcttaccttctggcataacaagatgttccaggctcatcttgaatgttccctaccctagccctggaatcagccatttctccagggagtcttggttccttataatggagaatggtatttatttatttttatttgatttgattattattactatttttgagacagagtctcgctcttgtcgcccaggctggattgcaatggcacaatctcagctcactgcaacctccacctaccaggttcaagcaattctcctgcctcagccttccaagtagctgggattacaggtgcctgcccccacacccagctaatttttgcatttttggtagaaatgggggttttaccatgttggggaggctggtctcgaactcctgacctcaggtgatctgcccacctcaacctcccaaagtgctgggattacaggtgtgagccaccatacccagccagagaatgttatttagaaaccaagatctgggtgccaaatgtgctgcttgttactggaatgtcattgcctctaggctctcaccatacagtgcaaagagatgatagatagatagatagatagatagatagatagatagatagatgatagatatagatagatagatagattgattgatttgtagaaacaagataggttagagatacctgacataaatagatactaaaaatcatgaattcacactgatgctttgagaccagccctgtaggtttattccagtctgcccccttttccatgttgttaactctttcctccagagagacaaagatttcaggttgctttgttaagttccatctaatgatcattctgacgtaagtctgtttttcttatttccttggaatgatgtctcctctggtttcagaacttcctcctctgcttcctgtatcctgaggctggcggggccagttgtctttagggcttgtgcatttttgtaaagagcttgcacgtgtggaaatcaagtaggccagtagtgggttaggggtactgagccagaagcctctacaaggaataacaggagcacaaaggaagaaggtggtattccagctggggacccaggagggaggactttgtggagaacctgatgcttgaactgagtctaaaaggtgtaaaagtgtttgttgcttctgcctccctgtctgtctggcagggtgaggtaggcgcatctagggaaatgtcaagtggcttggtgtagggtaaagtcagtgaggcccatggagaaaaacgagcaggagccacatcacatgggtgtctgataggacctgggaggcgctttccacattaccattgtcgcttcgtgatctggacacaccagaaggcgtgagactggaggcaggaagagcagccaggcttatccctaccctcaggagagctgaaaagggcaggtatggtggggccagagctcaggagagtttcggaaccactgagatcggtccttgatttgatgagaggcttgaggggagagggaggtagctaggatgccccgcaagcttctggcccagacactgggcagacaatgaaaccctttgtaacacatgaggcaataggtttggggcagatgggaggggaagcagtggtgggggcagtgagtgctgaaggtgttttaagaagcggctctgggccaggcacagtggcttatgcctgtattcctagcattttgggaggccgaggtgggagaatcacttgagcccaagaatttgagaccagcctggggaatatagtgagaccctgtccctacaaaaataaaaacaactagctgggtgtgtggtggtgcatgcctgtaggcccagctacgcgggaacatcacctgagcccaggaggttgaggttgcagtgagctacagttgcgccactgcactccagcctaggtgacagagcaagatcttgtctcaaaaaaaaaagcagctctggatgggaagggaggccagttgctttaagtaggggagatagagttaaaggaggctttgttttatttaaaggtgggacaaacttaagcatgttaataaaattcagagaagagaaagagaatgactatcagagccatgtttggaagaaaatggggtccagagcacaggaaggggacctgtgttcagagggtgcctcactgctgaggccacaggaaagaatctgtaggtggaggggaggccgaagaggggaagtttcatgcttgataattaaaattttctgagataggaatgtcatatttacctatttaagccaagtttttttagataaaaggtatggaacctgctttccccttggctagttcagcgtttgggctccggagtgctgaagatgaggactggacttcgagctggtgtgatcccagtattcagtgtcagtactcagtgacaaaataaatgagagaaacgggaataagaattgtcgcctacacaaaaataccagcaactgttaactcttcccagaagattttcattctgaatgctcctgtagctaggaaccctaaaaagtctttgaagcaactcaagttttaaaaaaggggaggaactcctggaaatctcaggatggggccaagatgtggctggagagtgtgtggtgatggagggcgtgtcttttgccgagcacactcagggcccacgggaagcccatagacttcaaggacatcaagccccaaggtggtgggattttccccaccagtacttggcagcctagggggaaggggagggcgggagaagataatggggatccctggctccaaacataggaggacacatctgtgctacagtgcgcacatgcctggatgtacactctgtctttggagacactggctaagattctctgctccatgtttggacagggtcgtgcctgatctgagataaatggacaagaacaactgaagcctgtcttctggtgcatgtgtcacctgccgataactgcatcttgtgataaagttgggtgatttacagtctccaccaaatgctaaactctggggtcttacgcctttataactccatgggccccagcaaaggttcaggctcaaaacaggtgtcaaatagataactgttgaatgattgttccccagttgcaggctctgccacctggcgttcatactgtctgtgaaaggacccagctcacctttccctctttatctcccagtccttcccaacagcgccgacacctcatggaaactgattgcaaatgtgctacttctcacttctgtgtggcccgaggaggctgggttaatgctgggcttggtaccttaagcaccctttctcccttccccatcttcattctcagaattacacctgtctgaagcaggcattttccaatgccctagatgggaatataagtgtaaggagatgtgaagcatttgcctgtgtgtcagaacattcactgaggatcctcataggcacttctagaaaccaaatccttgaagatgactaaccagaaatgcccgtcatagcactgtttacagttgcaaaaactgaagccaattgaaatgtccatcaggaggggattaaatgaattatggtacagttacaccgttgaatattttacagccattgaagatgatatatagctatattcattgacaaggaaaactcatattttttagtgaaaaaagcaggttatagaattgcatgatattcacatttatataaaactttatatatgggaaggatgttgattgaattgttaataactatggtcacctctagagatggaagtttgcattacctttaatttttaataccattttgtattgcttaaaatttgtatgtattatcgttaaaataagaaaaatcaaataaagctattttcattatgggaaaacaa

SEQ ID NO: 29508 - DNA, 1971 bp, Homo sapiens
gcgggtggaagaagatggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcagatgccacagtggagctatccttggacagcacacaaaataatcagaagaaggtgctagccaaaacactcatttctcttcctcctcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccgcccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcagg

SEQ ID NO: 29509 - DNA, 1374 bp, Homo sapiens
atggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcaggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccgcccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaa

SEQ ID NO: 29510 - DNA, 1374 bp, Homo sapiens; identical to SEQ ID NO: 29509

SEQ ID NO: 29511 - DNA, 3299 bp, Homo sapiens
agacgcggacgtcgctcttccaagatggcggcgcgtccgtcgcgagcgaccgggccgaggggaggccagcgaagccgagtaaaaccgccgcccgggagaagactgaaggagcagttgccgccgttggcggcggcccgagcagttttcgctgctgctacggctgtaataatgttaactgaggccagtctatccatatggggatggggaagccttggcattgtcctttttctgataacctttggaccctttgtaatattttatttgacattttatatcctctgctttgtgggtgggggtttagtggttactctcctgtttggaaaaacaaactcagagaagtacctagaacagtgtgaacactcatttcttcctccaacatcacctggggttcctaagtgcttagaagaaatgaaacgggaagccaggactattaagattgatagaagattgacgggtgccaatataattgatgaacctctccagcaagttatccagttttccttgagggattatgtccagtattggtattatacactaagcgatgatgaatcttttcttcttgaaattaggcagactcttcaaaacgcactcattcagtttgctactaggtcaaaagaaatagactggcaaccttattttactacacgcattgtagatgactttggcacacacttacgagtattcagaaaggctcaacagaaaataacagagaaagatgatcaagtgaaaggtacagcagaagatcttgtagataccttctttgaagttgaagttgaaatggagaaggaggtttgccgtgatctagtgtgcacttcccccaaagatgaagaaggattcctaagggatttgtgtgaggtcttactatatttattgctacctcctggagatttccagaacaagatcatgcgatactttgtcagggaaatccttgcacgaggaattcttcttccattaataaatcaactcagtgatcctgattatattaatcagtatgtcatatggatgatccgtgattctaactgcaactatgaggcctttatgaacattattaaattgagtgacaatattggagagctagaagcagtcagagataaggcagcagaagaattacagtatcttagatctctagatacagctggtgatgatatcaacactatcaaaaatcaaataaatagcttactattcgtaaagaaggtatgtgactcaagaatacagcgattgcagtcaggcaaagaaataaatactgtgaaacttgcagcaaactttgggaaactttgcacagtccccctggacagcattcttgtagacaatgttgcactacaattttttatggattacatgcagcaaactggaggtcaagcacatctattcttttggatgacagtggaaggataccgggttaccgcccaacagcagctagaagttttattaagtcgtcagagagatggaaaacatcaaaccaaccaaaccaaaggtcttttaagagcagctgctgttggaatttatgaacagtatttatcagaaaaggcatctccaagagttactgttgatgactatttagtagcaaaattagcagatactttgaatcatgaagatccaacccctgaaatctttgatgacattcaaagaaaggtatatgaattgatgctacgagatgaaagattttatccttccttcagacagaatgcactttatgtgcgcatgttagctgagcttgacatgttaaaagatcctagtttcagaggatccgatgatggggatggagaatcttttaatgggtctcctacaggaagcataaatttgtctttagatgacctttcaaatgtttcttctgatgactcagtacaacttcatgcctacatttcagacacaggcgtttgtaatgatcatggcaagacatatgcattatatgccatcactgtacaccggcgcaacctaaacagtgaggagatgtggaaaacctatcgtcgttatagtgacttccatgacttccacatgagaatcactgaacagtttgaaagtctctcaagcatattgaaacttcctggaaaaaagacttttaataatatggatagagattttttagaaaagagaaaaaaggatctaaatgcatatttgcagttactgttagctcctgaaatgatgaaggcatcccccgctttagctcactatgtgtatgatttccttgagaacaaagcctacagtaaaggaaaaggggattttgctcgcaagatggacacttttgtaaatccacttcgcaattcaatgaggaatgtttcaaatgcagttaaatcccttcctgatagcttggcagagggaatgactaaaatgtcagacaacatgggcaaaatgtcagaaagattaggtcaagacataaagcaatcattttttaaggtgcctcctttaattcctaagactgattcagaccctgaacatcgccgagtttcggctcaacttgacgataatgtggatgacaatattccacttagggtaatgctgcttctcatggatgaagtattcgacttaaaagaaagaaatcagtggttgcgaaggaatatcaaaaacctacttcaacagcttattagagctacatatggcgatactattaatagaaaaatagttgaccatgttgactggatgacttcacctgaacaagtagccgactcagtgaaacgtttcagagatgcattttggccaaatggcattttagcagaggctgttccatgcagagataaaagtattcgaatgagaacaagagtagcaggaaaaacgaaattacttgcaattatgccagatgagctgaagcacattattggggctgagacaacacggaaaggtattcttcgtgtttttgaaatgtttcagcacaaccaattaaataggagaatggtttatgtcttcttggaaggctttttagaaaccttatttccacagtataaattccgtgaacttttcaacaaactgcattcacggtcaaagcagatgcagaaatataaacagaaacttcaaactactcaagcgccttctttgcagaaaaggtgacactccactctatgaagctggtgttcattttgtccaggactaatggtatggacagatcttctggggcttaactcaaatactgttgtgtctgcaccagtcttttagtgtctcaaaatagattattaatacatccataagtctgtggttcttctcattctcatctataatccaccactaccaagagagatttctgtgtcttaaatgatttggtgcatattttgcaacattgagagaaaactgcccccatctcaagcaag

SEQ ID NO: 29512 - DNA, 4132 bp, Homo sapiens
gctcttccaagatggcggcgcgtccgtcgcgagcgaccgggccgaggggaggccagcgaagccgagtaaaaccgccgcccgggagaagactgaaggagcagttgccgccgttggcggcggcccgagcagttttcgctgctgctacggctgttgccatgaggcgaggctagggaggacctcacttccccggggtgtaataatgttaactgaggccagtctatccatatggggatggggaagccttggcattgtcctttttctgataacctttggaccctttgtaatattttatttgacattttatatcctctgctttgtgggtgggggtttagtggttactctcctgtttggaaaaacaaactcagagaagtacctagaacagtgtgaacactcatttcttcctccaacatcacctggggttcctaagtgcttagaagaaatgaaacgggaagccaggactattaagattgatagaagattgacgggtgccaatataattgatgaacctctccagcaagttatccagttttccttgagggattatgtccagtattggtattatacactaagcgatgatgaatcttttcttcttgaaattaggcagactcttcaaaacgcactcattcagtttgctactaggtcaaaagaaatagactggcaaccttattttactacacgcattgtagatgactttggcacacacttacgagtattcagaaaggctcaacagaaaataacagagaaagatgatcaagtgaaaggtacagcagaagatcttgtagataccttctttgaagttgaagttgaaatggagaaggaggtttgccgtgatctagtgtgcacttcccccaaagatgaagaaggattcctaagggatttgtgtgaggtcttactatatttattgctacctcctggagatttccagaacaagatcatgcgatactttgtcagggaaatccttgcacgaggaattcttcttccattaataaatcaactcagtgatcctgattatattaatcagtatgtcatatggatgatccgtgattctaactgcaactatgaggcctttatgaacattattaaattgagtgacaatattggagagctagaagcagtcagagataaggcagcagaagaattacagtatcttagatctctagatacagctggtgatgatatcaacactatcaaaaatcaaataaatagcttactattcgtaaagaaggtatgtgactcaagaatacagcgattgcagtcaggcaaagaaataaatactgtgaaacttgcagcaaactttgggaaactttgcacagtccccctggacagcattcttgtagacaatgttgcactacaattttttatggattacatgcagcaaactggaggtcaagcacatctattcttttggatgacagtggaaggataccgggttaccgcccaacagcagctagaagttttattaagtcgtcagagagatggaaaacatcaaaccaaccaaaccaaaggtcttttaagagcagctgctgttggaatttatgaacagtatttatcagaaaaggcatctccaagagttactgttgatgactatttagtagcaaaattagcagatactttgaatcatgaagatccaacccctgaaatctttgatgacattcaaagaaaggtatatgaattgatgctacgagatgaaagattttatccttccttcagacagaatgcactttatgtgcgcatgttagctgagcttgacatgttaaaagatcctagtttcagaggatccgatgatggggatggagaatcttttaatgggtctcctacaggaagcataaatttgtctttagatgacctttcaaatgtttcttctgatgactcagtacaacttcatgcctacatttcagacacaggcgtttgtaatgatcatggcaagacatatgcattatatgccatcactgtacaccggcgcaacctaaacagtgaggagatgtggaaaacctatcgtcgttatagtgacttccatgacttccacatgagaatcactgaacagtttgaaagtctctcaagcatattgaaacttcctggaaaaaagacttttaataatatggatagagattttttagaaaagagaaaaaaggatctaaatgcatatttgcagttactgttagctcctgaaatgatgaaggcatcccccgctttagctcactatgtgtatgatttccttgagaacaaagcctacagtaaaggaaaaggggattttgctcgcaagatggacacttttgtaaatccacttcgcaattcaatgaggaatgtttcaaatgcagttaaatcccttcctgatagcttggcagagggaatgactaaaatgtcagacaacatgggcaaaatgtcagaaagattaggtcaagacataaagcaatcattttttaaggtgcctcctttaattcctaagactgattcagaccctgaacatcgccgagtttcggctcaacttgacgataatgtggatgacaatattccacttagggtaatgctgcttctcatggatgaagtattcgacttaaaagaaagaaatcagtggttgcgaaggaatatcaaaaacctacttcaacagcttattagagctacatatggcgatactattaatagaaaaatagttgaccatgttgactggatgacttcacctgaacaagtagccgactcagtgaaacgtttcagagatgcattttggccaaatggcattttagcagaggctgttccatgcagagataaaagtattcgaatgagaacaagagtagcaggaaaaacgaaattacttgcaattatgccagatgagctgaagcacattattggggctgagacaacacggaaaggtattcttcgtgtttttgaaatgtttcagcacaaccaattaaataggagaatggtttatgtcttcttggaaggctttttagaaaccttatttccacagtataaattccgtgaacttttcaacaaactgcattcacggtcaaagcagatgcagaaatataaacagaaacttcaaactactcaagcgccttctttgcagaaaaggtgacactccactctatgaagctggtgttcattttgtccaggactaatggtatggacagatcttctggggcttaactcaaatactgttgtgtctgcaccagtcttttagtgtctcaaaatagattattaatacatccataagtctgtggttcttctcattctcatctataatccaccactaccaagagagatttctgtgtcttaaatgatttggtgcatattttgcaacattgagagaaaactgcccccatctcaagcaagaatggcgttggtttcttccatttcaaactaatcagcattctccagcaatgacaaagtgccagagtgtatatatgaaagctaaggaaagcacaaaacaatggttcagagataaattggctaatttgtttaacagttggagactgtgcaatgtacgacttggaggagtttgtttggcataatgattttgtaggtctgtcagcattttgatatattgtggattagccaggtgaatgatccttgaaacatctctttcaggtctggagaaagagacagaatgcccttaaagtgtgaaataaccttatacctgaattacagttttgtgatataaaataaagctgagtataaaataaaaccaatcaaacacagaatttgattggatttgttattcattggtatacaacaatttttattcttatgtgtgctttaagggctgtgttttgctcttagggtactcaattttatgtttccttttggcattctttgtgcaaaaagaagcatgtggtggctctcatttaaatttcaaaattattagttttatctttaacagattactgattatacagaagatataatttattggaagaactgccaaatacattttgtccttctaaaaatatggaaatttaaatagtagtctggaaagttaccatatgataatttttaattgtgtgatctagacatgccttaggtaactgcagaaatagcaaattaaatgattaatgagcttattagtcatagtaaacatacagattcctaattctatgacagtgtacatatatgaaaataaatgatgaaaaaagaa

SEQ ID NO: 29513 - DNA, 771 bp, Homo sapiens
atgtcccgccaggcgaaggatgacttcctgcggcactacacagtgtcggaccccaggactcaccccaagggctacaccgagtacaaagtaaccgcgcagttcatctcaaagaaggacccagaggatgtcaaagaggtggtggtctggaagcggtacagcgacttccgcaagctgcatggagacctggcctacacccaccgcaacctcttccgccgcctcgaggagttccctgctttcccccgggcccaggtgtttggccggtttgaagcctcagtgatcgaggagcggcgaaagggggcagaggacctgcttcgcttcactgtgcacatacctgcgctcaacaacagcccccagctcaaggagttcttccggggtggggaggtgacccgacccttggaggtgtccagggacctacacatcctgccaccccctctgatccccaccccgccccctgatgacccccggctatcccaactgctccctgcagaaaggaggggcctcgaggaattggaggtgccagtggaccccccaccatccagccctgcccaggaggccctggatctcctctttaactgtgagagcaccgaggaggcatctggttcccctgcccgaggccccctcaccgaggctgagcttgccctcttcgaccccttctccaaggaaggtgacccgttgcctgcccgccaggaaggtgtgaagaagaaggcagctgagtacctgaagcgggcagaggagatcctgcgcctgcacctgtctcaactcccaccctaa

SEQ ID NO: 29514 - DNA, 1939 bp, Homo sapiens
gacaaaatccctaggccagaggaagaagagcgcaggcctggcgaggcggcggcgggcggaggctgggccggaggggtggggacggcgaggaggtggaggccggcgctccgctccgctccagctcggtttcatgtcccgccaggcgaaggatgacttcctgcggcactacacagtgtcggaccccaggactcaccccaagggctacaccgagtacaaagtaaccgcgcagttcatctcaaagaaggacccagaggatgtcaaagaggtggtggtctggaagcggtacagcgacttccgcaagctgcatggagacctggcctacacccaccgcaacctcttccgccgcctcgaggagttccctgctttcccccgggcccaggtgtttggccggtttgaagcctcagtgatcgaggagcggcgaaagggggcagaggacctgcttcgcttcactgtgcacatacctgcgctcaacaacagcccccagctcaaggagttcttccggggtggggaggtgacccgacccttggaggtgtccagggacctacacatcctgccaccccctctgatccccaccccgccccctgatgacccccggctatcccaactgctccctgcagaaaggaggggcctcgaggaattggaggtgccagtggaccccccaccatccagccctgcccaggaggccctggatctcctctttaactgtgagagcaccgaggaggcatctggttcccctgcccgaggccccctcaccgaggctgagcttgccctcttcgaccccttctccaaggaagaaggcgcagcccccagccccacccatgtggctgagctggcaacgatggaggtggagtctgcaaggctggaccaggaaccctgggagccaggagggcaggaggaggaagaggatggggaaggagggcccacccctgcctacctaagccaggccacagagctcatcacccaggccctgcgggatgagaaggcaggcgcttacgctgctgcactccagggctatcgagacggcgtgcacgtcttgcttcagggagtccccagtgacccgttgcctgcccgccaggaaggtgtgaagaagaaggcagctgagtacctgaagcgggcagaggagatcctgcgcctgcacctgtctcaactcccaccctaacagggagtgggccattccctgggactctcgctcctgcactgccagccccttctcctctccccagggcctggccctacctcctggtcttgtaattacaggagccatttctgtaggtaactggaccaagaatgagaaaaataatgaattcttagctccctgattacacctgccaccttggaatcaaggactcacacttctgaccctgcctgtctttttggggtttttttgagttggagtctcgctgtgtcgcccagactggagtgcagtggtgggatcgcggctcactgcaacctccacctcccaggttcaagcagttctcctgtctcagcctccccagtagctgagattgcaggcacatgccaccacgcccagctaatattttgtattttcagtagggacggggttacaccatgttggccaggctggtctcgaactcctgacctcaagtgatccacccgcctcagtctcccaaagtgctgagattacaggcatgagtcactacgcccggcccatgtctgtctgtcttgatgtgtgagcagcagctgtggtcattaaaccattagtttacccctctagaactggggtctgcaaactcccacctgcagccaaatctggcccacctcctttttaatgtaagggctgtgagagtggtttttactttttttaatgattaaaaaaatcaaaataatattctgtgacaatgacaggtgaaatttatatgtgacaagtgaaaattatatgaaatttaagagtccataaataaaatttgttggaacacaa

SEQ ID NO: 29515 - DNA, 2044 bp, Homo sapiens
ccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgccta

SEQ ID NO: 29516 - DNA, 1451 bp, Homo sapiens
aaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtgcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctcc

SEQ ID NO: 29517 - DNA, 1844 bp, Homo sapiens
acttttgtgtcctcaggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttctatagactggactcacctagatggcagccaagggtggggcaggtgaagaatttatgcaaacagtgagtgagttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgct

SEQ ID NO: 29518 - DNA, 1567 bp, Homo sapiens
atcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgcc

SEQ ID NO: 29519 - DNA, 2128 bp, Homo sapiens
aggccggccgggggcggggaggctggcgggtcggcgcgggcccagccgtgcgtgctcacgtgacgggtccgcgaggcccagctcgcgcagtcgttcgggtgagcgaagatggcggccgagagggaacctcctccgctgggggacgggaagcccaccgactttgaggatctggaggacggagaggacctgttcaccagcactgtctccaccctagagtcaagtccatcatctccagaaccagctagtcttcctgcagaagatattagtgcaaactccaatggcccaaaacccacagaagttgtattagatgatgacagagaagatctttttgcagaagccacagaagaagtttctttggacagccctgaaagggaacctatcctatcctcggaaccttctcctgcagtcacacctgtcactcctactacactcattgctcctagaattgaatcaaagagtatgtctgctcccgtgatctttgatagatccagggaagagattgaagaagaagcaaatggagacatttttgacatagaaattggtgtatcagatccagaaaaagttggtgatggcatgaatgcctatatggcatatagagtaacaacaaagacatctctttccatgttcagtaagagtgaattttcagtgaaaagaagattcagcgactttcttggtttgcacagcaaattagcaagcaaatatttacatgttggttatattgtgccaccagctccagaaaagagtatagtagggatgaccaaggtcaaagtgggtaaagaagactcatcatccactgagtttgtagaaaaacggagagcagctcttgaaaggtatcttcaaagaacagtaaaacatccaactttactacaggatcctgatttaaggcagttcttggaaagttcagagctgcctagagcagttaatacacaggctctgagtggagcaggaatattgaggatggtgaacaaggctgccgacgctgtcaacaaaatgacaatcaagatgaatgaatcggatgcatggtttgaagaaaagcagcagcaatttgagaatctggatcagcaacttaggaaacttcatgtcagtgttgaagccttggtctgtcatagaaaagaactttcagccaacacagctgcctttgctaaaagtgctgccatgttaggtaattctgaggatcatactgctttatctagagctttgtctcagcttgcagaggttgaggagaagatagaccagttacatcaagaacaagcttttgctgacttttatatgttttcagaactacttagtgactacattcgtcttattgctgcagtgaaaggtgtgtttgaccatcgaatgaagtgctggcagaaatgggaagatgctcaaattactttgctcaaaaaacgtgaagctgaagcaaaaatgatggttgctaacaaaccagataaaatacagcaagctaaaaatgaaataagagagtgggaggcgaaagtgcaacaaggggaaagagattttgaacagatatctaaaacgattcgaaaagaagtgggaagatttgagaaagaacgagtgaaggattttaaaaccgttatcatcaagtacttagaatcactagttcaaacacaacaacagctgataaaatactgggaagcattcctacctgaagccaaagccattgcctagcaataagattgttgccgttaagaagaccttggatgttgttccagttatgctggattccacagtgaaatcatttaaaaccatctaaataaaccactatatattttatgaattacatgtggttttatatacacacacacacacacacacacacacacacacacactctgacattttattacaagctgcatgtcctgaccctctttgaattaagtggactgtggcatgacattctgcaatactttgctgaattgaacactattgtgtcttaaatacttgcactaaatagtgcactgcaagaccagaaaattttacaatattttttctttacaatatgttctgtagtatgtttaccctctttatgaagtgaattaccaatgctttgaataatgttcacttatacattcctgtacagaaattacgattttgtgattacagtaataaaatgatattccttgtgaaa

SEQ ID NO: 29520 - DNA, 3304 bp, Homo sapiens
gggcgatcagaagcaggtcacacagcctgtttcctgttttcaaacggggaacttagaaagtggcagcccctcggcttgtcgccggagctgagaaccaagagctcgaaggggccatatgacactcctcccggacccctggacacacacagccctggagactggagccttggagcatggcaagtccagagcaccctgggagccctggctgcatgggacccataacccagtgcacggcaaggacccagcaggaagcaccagccactggccccgacctcccgcacccaggacctgacgggcacttagacacacacagtggcctgagctccaactccagcatgaccacgcgggagcttcagcagtactggcagaaccagaaatgccgctggaagcacgtcaaactgctctttgagatcgcttcagctcgcatcgaggagagaaaagtctctaagtttgtgatggggaaatcaaggcctggagagatgacttatccagggtcacgtggcgagacagggacagcaccagaaccagacccgagatgtccacgtcaaagtgacatgctctgagaggcagcacacacagaataaccctgcatccaaattccaggaagctcttaggggtcatccagctgggcctaggggtgcagggtcagtgctgaggcctgggcagggccgctagcctccctgagctttctggcttcaggctgggaggcacagttcagggtggactgtgaccccttggcctagaatgcccttagctctgctctctagtggctgtccccatagctggaactctgttttggagtggcaaaaccagttccacctgctggtaggggtaggttggctcccaacacatccccagcaggcctctcttgggctcaaaagccaagctgtgcccagccacgtctccaaatgcttcctggcccccatgcagcaactgcatttagctgccttcccagaatttcctgcatgctcacacagcccttccctctggggcccaacaatgccacagcctgttctatcaatcaccagctgttttcctttgagcagtctccttttacttatgcacatttacttgaaaaagaaacttcctattactatcctaaatggaaactcagaatcacttgctataattagaaagtagctacaaaaataaacacaatgaaaccgatcactgttattacaccctaacccgcttttacctgagacaggccctgagcctgaggccgctggtagacttttgttaaaagagagagagacagagacagagaaataagcattagagacctgcaatcaccaagctgagacttctctttgatttactcagaaggactggaaaatgttgtcctgcaaaaggaggtaagtttctcaccacgtagcgctgatcatcccgtgttgcccgtgcgttgctgcagaccatctggggtcttgcccaagcaccctggagactttgctccctggtttcctggtcaccaactcgagtgttcagccctgtgtgctctccagctcctaagtcgtgggcctggtttcagctttgattgcccactcttggctttcaacccgtaggctccggctcctgacgccacaccctgatatcaagaccctcagatggagcgagcgttctgggctggtcgaagcctgaagccgcagtatgtccttgagtgggtccccccctacccatctagctgttgcccccatggtaagatcaagaaaatgccctcccctccaaaagtccccacgccgagccctcatctgtcagctcccaggctcggccccctcactagctccaggctgggaggcacagttcagggcagactgtggcccctcagcatagcatggacttagctctgctctctagtggctgtccccatagctagaactctgttttggagcagcaaaactagttccacctgctggtagggctaagttgactcccaacatgtccccagcgtgttggtgttgggaaccttgatctagctgctcgttttctcagtaaccaaagatccctggcactcctacgatgtctcaggccttatctagagctggggatacagcagtgaccaggacagaactggtccctgcctcacggaagtgaagtgtcaggaggccactcccaaagcaaatggaagctgggacagaatgatgtcctcagccaggtggtcagggaaggcttctcagagggggcgctgttcaaagaatcacagagcatacaaaggagctggccctgggagcacagagaggggagaattttaggcaaagaggtagcaggagcacagccctgaggcaggaaactacccccccaccaccctcggcatcctcagttctggtttgcacccagaaagggggtaggtccaggacacacccggactgatgtgtcacactggctgtgccagctgagagagtgggctccaggcaccactaacagagaagccttgcaaggcaggtccatgcaccgcccgcctccagttaccactcattgcaaaggaaatgagctgggagcctgtgtgtgggccgtgcagacccttttggttacaagccacaaaaacccaggttaatctgatgaggaaggaatttattatctgtaaagtccaggagcaggctagctttacaccaagcaggatccaaggacccacacttgtcacctcatatctctctctctctcccactttcgctttctctgtctcttcttagttctgctttcctccactgtgccttcgctctcagagagagctctcccctggcagtgacaagatggctgcagcagctccagcaacctcagaggactcccccatccagggtccttgtgagctcctcatctgtaggatgtgcagtaaacactcacgtgtcctttcctgaggagcccagtggctggggtgggggctgaggggcagcccctatgccctcacagtgcagcaaccttggttagctcacccatcagggcagacttgggcagaaatcatgtcttggcatattgttttgtaatctgctttttaaattgtcactatatattatgagcatttccctataatatacaatattcttccacattatgtttaatggtttcattgtattctaatgcatattctatagttattttaaccaccccacaatgttgcaaaatgtccttatttgggacaacactgctgcaaacactttgacccatatgtcctttttgtgtgcactcttatggcaacttctaacggtggcatttctgaatcatagacacttttttgacttctacatattttatttttttagttgacaaaaactgtatttatgaatcataaacacttaatgattttgctatt

SEQ ID NO: 29521 - DNA, 2864 bp, Homo sapiens
aaacggggaacttagaaagtggcagcccctcggcttgtcgccggagctgagaaccaagagctcgaaggggccatatgacactcctcccggacccctggacacacacagccctggagactggagccttggagcatggcaagtccagagcaccctgggagccctggctgcatgggacccataacccagtgcacggcaaggacccagcaggaagcaccagccactggccccgacctcccgcacccaggacctgacgggcacttagacacacacagtggcctgagctccaactccagcatgaccacgcgggagcttcagcagtactggcagaaccagaaatgccgctggaagcacgtcaaactgctctttgagatcgcttcagctcgcatcgaggagagaaaagtctctaagtttgtggtgtaccaaatcatcgtcatccagactgggagctttgacaacaacaaggccgtcctggaacggcgctattccgacttcgcgaagctccagaaagcgctgctgaagacgttcagggaggagatcgaagacgtggagtttcccaggaagcacctgactgggaacttcgctgaggagatgatctgtgagcgtcggcgcgccctgcaggagtacctgggcctgctctacgccatccgctgcgtgcgccgctcccgggagttcctggacttcctcacgcggccggagctgcgcgaggctttcggctgcctgcgggccggccagtacccgcgcgccctggagctgctgctgcgcgtgctgccgctgcaggagaagctcaccgcccactgccctgcggccgccgtcccggccctgtgcgccgtgctgctgtgccaccgcgacctcgaccgccccgccgaggccttcgcggccggagagagggccctgcagcgcctgcaggcccgggagggccatcgctactatgcgcctctgctggacgccatggtccgcctggcctacgcgctgggcaaggacttcgtgactctgcaggagaggctggaggagagccagctccggaggcccacgccccgaggcatcaccctgaaggagctcactgtgcgagaatacctgcactgagccggcctgggaccccgcagggacgctggagatttggggtcaccatggctcacagtgggctgtttggggttctttttttttatttttccttttcttttttgttatttgagacagtcttgctctgtcacccagactgaagtgcagtggctcaattatgtctcactgcagcctcaaactcctgggcacaagcaatcctcccacctcagcctcccaagtagctgggattacaggtgcacaccaccacaccaggctaatttttaattttttagtagagacagggtctctctgttgcccaggctggtctctaacttctgaccttaaatgatcttcctgcctcagcttcccaaaacactggggttacaagtgtgagccaccacccctggcctggggttcatttttaatgggaaaagccactgggggctctaactcgctgggtgactttggacaagcccctcctctggtcctcaatttctccatctgtattggacagaggtgctcctgggaccccttggaagcctctgcttgtgtcccacgtcctcttgatgccagggccacttcatctccaaaacacaaaaccaactgccaaaaccgtccagagcagtgtccaccccaccagtgtctttgtgggaagctggagaagaagtttacctcacacattctagacaaaacttagtccatttccttgaagacagttctctccagctgctccaaggcttttctctctgttccttccaccttggaattgctttaaaatatttccatccattatcctaatactatcttagtattctagcccttcccccttaccatgtagacctgacaaagcaaaacaaaagctcacctattgccctcaagaacagcctctacacacacacacacacacacacacacacacacacacacacacacggtgggagttgtatgccatccttttgaagggtgggaggaccctggaccagaaagcaataatggcataagattctgtgataccaggcatttttggcaagggaagttgccaacaatttttctggctgggatggcatagcacattgtctaggggtggattttcattcataaggcagctgttccctgaatggcttccctgggttatgtagaaacagcctggggaggaggtgatacaacatacttaatggggcctctgggcagaaaacagactgaatcctcaacactgccccttttgagggtctgtgatcctggaacttctctgatggactgggatgcccttaactgaggtctgctgtctggaaaggacaccacaggcccagaatgaaggggcatctggaccaatgacctagattcaacacagggcttggagctggtggtacaggctggttttggcccaatgtgtgttggaggctggaagcccctgaagacctaaactgcctggatgagcttattagggtgaattaatgagtctgtaatttgggaaccttaatgtgagacaccacttaaggagaggaacttggcccagcaagtgatcactctagaagtggacagctatgcactagactgcaccagaatctgttcaacagcgacaccttgtggtaaaaactgtagacgccccatcaggctggatgggaaactagaaacagactgtctcatctttggacagatatccctcaaatctcccaatctactccagggaaaagacacttcaagtgagagatattggacttcttgaaaatctaggcctatggaaaattaaagtgttaaatggaaaaattaaagagctatgagtctatttgtaatgatgaaacaga

SEQ ID NO: 29522 - DNA, 632 bp, Homo sapiens
gggcgatcagaagcaggtcacacagcctgtttcctgttttcaaacggggaacttagaaagtggcagcccctcggcttgtcgccggagctgagaaccaagagctcgaaggggccatatgacactcctcccggacccctggacacacacagccctggagactggagccttggagcatggcaagtccagagcaccctgggagccctggctgcatgggacccataacccagtgcacggcaaggacccagcaggaagcaccagccactggccccgacctcccgcacccaggacctgacgggcacttagacacacacagtggcctgagctccaactccagcatgaccacgcgggagcttcagcagtactggcagaaccagaaatgccgctggaagcacgtcaaactgctctttgagatcgcttcagctcgcatcgaggagagaaaagtctctaagtttgtggtgtaccaaatcatcgtcatccagactgggagctttgacaacaacaaggccgtcctggaacggcgctattccgacttcgtgactctgcaggagaggctggaggagagccagctccggaggcccacgccccgaggcatcaccctgaaggagctcactgtgcgagaatacctgcactga

SEQ ID NO: 29523 - DNA, 2197 bp, Homo sapiens
gggcgatcagaagcaggtcacacagcctgtttcctgttttcaaacggggaacttagaaagtggcagcccctcggcttgtcgccggagctgagaaccaagagctcgaaggggccatatgacactcctcccggacccctggacacacacagccctggagactggagccttggagcatggcaagtccagagcaccctgggagccctggctgcatgggacccataacccagtgcacggcaaggacccagcaggaagcaccagccactggccccgacctcccgcacccaggacctgacgggcacttagacacacacagtggcctgagctccaactccagcatgaccacgcgggagcttcagcagtactggcagaaccagaaatgccgctggaagcacgtcaaactgctctttgagatcgcttcagctcgcatcgaggagagaaaagtctctaagtttgtggctccggctcctgacgccacaccctgatatcaagaccctcagatggagcgagcgttctgggctggtcgaagcctgaagccgcagtatgtccttgagtgggtccccccctacccatctagctgttgcccccatggtaagatcaagaaaatgccctcccctccaaaagtccccacgccgagccctcatctgtcagctcccaggctcggccccctcactagctccaggctgggaggcacagttcagggcagactgtggcccctcagcatagcatggacttagctctgctctctagtggctgtccccatagctagaactctgttttggagcagcaaaactagttccacctgctggtagggctaagttgactcccaacatgtccccagcgtgttggtgttgggaaccttgatctagctgctcgttttctcagtaaccaaagatccctggcactcctacgatgtctcaggccttatctagagctggggatacagcagtgaccaggacagaactggtccctgcctcacggaagtgaagtgtcaggaggccactcccaaagcaaatggaagctgggacagaatgatgtcctcagccaggtggtcagggaaggcttctcagagggggcgctgttcaaagaatcacagagcatacaaaggagctggccctgggagcacagagaggggagaattttaggcaaagaggtagcaggagcacagccctgaggcaggaaactacccccccaccaccctcggcatcctcagttctggtttgcacccagaaagggggtaggtccaggacacacccggactgatgtgtcacactggctgtgccagctgagagagtgggctccaggcaccactaacagagaagccttgcaaggcaggtccatgcaccgcccgcctccagttaccactcattgcaaaggaaatgagctgggagcctgtgtgtgggccgtgcagacccttttggttacaagccacaaaaacccaggttaatctgatgaggaaggaatttattatctgtaaagtccaggagcaggctagctttacaccaagcaggatccaaggacccacacttgtcacctcatatctctctctctctcccactttcgctttctctgtctcttcttagttctgctttcctccactgtgccttcgctctcagagagagctctcccctggcagtgacaagatggctgcagcagctccagcaacctcagaggactcccccatccagggtccttgtgagctcctcatctgtaggatgtgcagtaaacactcacgtgtcctttcctgaggagcccagtggctggggtgggggctgaggggcagcccctatgccctcacagtgcagcaaccttggttagctcacccatcagggcagacttgggcagaaatcatgtcttggcatattgttttgtaatctgctttttaaattgtcactatatattatgagcatttccctataatatacaatattcttccacattatgtttaatggtttcattgtattctaatgcatattctatagttattttaaccaccccacaatgttgcaaaatgtccttatttgggacaacactgctgcaaacactttgacccatatgtcctttttgtgtgcactcttatggcaacttctaacggtggcatttctgaatcatagacacttttttgacttctacatattttatttttttagttgacaaaaactgtatttatgaatcataaacacttaatgattttgctatt

SEQ ID NO: 29524 - DNA, 1755 bp, Homo sapiens
agtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgcactgattgtgttgcctccagctttttttgctctctatgagtgactacttaagtcacttgttgagagggattatttactaattatatacttctcattcctgtaactccattccctttaaacagtggtgatatcaaatatacttccatccattgaatggggtatttttaacaacaacaaaagtgatatactaaaaaatgtattgcttaaggcttattgaatcattttgaagcactttgtgtatttgaaaactgctttataatctcatttattaaaaggactttcaaagataaaa

SEQ ID NO: 29525 - DNA, 890 bp, Homo sapiens
gtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatacaaatcttcctattttcaagctgaaagaatctactgttagaagaagatacagtgactttgaatggctgcgaagtgaattagaaagagagagcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttt

SEQ ID NO: 29526 - DNA, 681 bp, Homo sapiens
agtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaagccctgcctcagaatgacatcagaggcaaggagtcatggaaggacgtggtgtgctcagaatgatgaaaagttattttgtgactag

SEQ ID NO: 29527 - DNA, 1072 bp, Homo sapiens
gggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgca

SEQ ID NO: 29528 - DNA, 2506 bp, Homo sapiens
gggttcgccgcgccgaactgcagccatggagcaggcacctccggaccccgagcggcagctccagccggcgcccttggagccgctgggctccccagacgctgggctgggggctgcggtcggcaaggaagcggagggggccggagaagagagctctggggtcgacacgatgacacacaataatttttggttgaagaagatagaaatcagtgtttcagaagcagaaaaacgaactggaagaaatgccatgaacatgcaagaaacatatactgcttacctcattgaaacaaggtcagttgaacataccgatggtcagagtgtcctaacagactcactatggcggcgatatagtgaatttgagttgttgagaagctaccttttagtttactatccacatattgttgtgccacctctgccagaaaaacgggcagaatttgtttggcataaactctctgctgacaacatggatccagattttgtggagaggcgacggattggtttagaaaactttctcttgaggattgcttcacatcccatcctttgtagagacaaaatcttctatctgtttttaacacaggaaggtaactggaaggagactgtgaatgaaactgggtttcagctgaaggcagactccaggttaaaagcgcttaatgcaacattcagagtgaaaaacccagacaagagatttactgaccttaagcactatagtgatgaactgcagtctgtcatctcacatcttcttcgagtcagagctagagtagcagatcgactctatggtgtatataaagtacatgggaattatggtcgagttttcagtgaatggagtgccatagaaaaagaaatgggtgatggactgcagagtgctggtcatcatatggatgtgtatgcatcttctattgatgatattttggaagatgaagaacattatgcagatcagttaaaagagtatcttttttatgcagaagcattgcgggctgtgtgcaggaaacatgaacttatgcagtatgacttggagatggctgctcaggacttagcatccaagaagcagcagtgtgaggaactggtaactgggactgtgagaacattctctttgaagggaatgactaccaagctctttggtcaagaaactccagagcagagagaagccagaataaaggtgctagaagaacaaataaatgaaggagaacaacagctaaagtctaaaaatctggaaggcagagaatttgtgaaaaacgcatgggctgatattgaacgcttcaaagaacaaaagaaccgagacttaaaggaggccctcataagctatgcagtcatgcagatcagtatgtgcaaaaagggaattcaagtttggaccaatgctaaggaatgctttagcaagatgtaatcctgtgaattgaatttctcttcaatcaaagtgccccaaaacagaagcacaagtaaataaaagaaatttaagtcactacctagtatacataaacatatacaataagttaaataaattcagctttctttaacttaattgtggtcgtgttaatgtagcacaaaaaatatattttaatgaagattaaatattataatttgaggttttggggactggtgctgattccaaaaagttaatttaataatatataccaacagattgtttgtcacgcttctgaaccaatgactgaatgtcaagatgttcgttaatttctagatgtttgtttcaagaccagctgtttcagatctattaatgtagggaatttttccctaagattgaattcctatatttacttggtaagatccactaatctgttatagggagttgttttctcttgccttatagttgagctatttggtttgacaaagctcagcagaaacttgatgtgaaaaatctacgattttcttctacattcattgatgccccttgtaatgtttgcatacactagaaaatgccttcaatttgtgttttaccagaattttgatactggtcagaaattttatactgccaacaaagaagactcaacttctcagatctataatgggatacattgtcatcctctagcaactcctatatagaaagttttaactgaatatgttacatataagaattaaattcttctcaaataattcttaacctcagtaatgagcctaaatttactctgcttggctctctacacatggcatttcagggtataagatgtagcatttcaatgtgtaagatatatgtactaaacatatgtgttgctatcttcatcattaacatccttcttttctattgcttggctgtaatttttgtaaagataaattatattgtttttttgtatgtgtgtttgtagtatatgttcagaaggcaagcatcttcattttgctagctttgcagaatcttaaaatgtgtactcgttatttctaatgatgtaaaaaaaaatccctagtcctgtttagcatttgacttttttatatgttttaaatgttgctggatttttgtgctgtttgccaaacttatacaataaataaatgaaatattgtgctg

SEQ ID NO: 29529 - DNA, 1308 bp, Homo sapiens
actgcagccatggagcaggcacctccggaccccgagcggcagctccagccggcgcccttggagccgctgggctccccagacgctgggctgggggctgcggtcggcaaggaagcggagggggccggagaagagagctctggggtcgacacggtcagttgaacataccgatggtcagagtgtcctaacagactcactatggcggcgatatagtgaatttgagttgttgagaagctaccttttagtttactatccacatattgttgtgccacctctgccagaaaaacgggcagaatttgtttggcataaactctctgctgacaacatggatccagattttgtggagaggcgacggattggtttagaaaactttctcttgaggattgcttcacatcccatcctttgtagagacaaaatcttctatctgtttttaacacaggaaggtaactggaaggagactgtgaatgaaactgggtttcagctgaaggcagactccaggttaaaagcgcttaatgcaacattcagagtgaaaaacccagacaagagatttactgaccttaagcactatagtgatgaactgcagtctgtcatctcacatcttcttcgagtcagagctagagtagcagatcgactctatggtgtatataaagtacatgggaattatggtcgagttttcagtgaatggagtgccatagaaaaagaaatgggtgatggactgcagagtgctggtcatcatatggatgtgtatgcatcttctattgatgatattttggaagatgaagaacattatgcagatcagttaaaagagtatcttttttatgcagaagcattgcgggctgtgtgcaggaaacatgaacttatgcagtatgacttggagatggctgctcaggacttagcatccaagaagcagcagtgtgaggaactggtaactgggactgtgagaacattctctttgaagggaatgactaccaagctctttggtcaagaaactccagagcagagagaagccagaataaaggtgctagaagaacaaataaatgaaggagaacaacagctaaagtctaaaaatctggaaggcagagaatttgtgaaaaacgcatgggctgatattgaacgcttcaaagaacaaaagaaccgagacttaaaggaggccctcataagctatgcagtcatgcagatcagtatgtgcaaaaagggaattcaagtttggaccaatgctaaggaatgctttagcaagatgtaatcctgtgaattgaatttctcttcaatcaaagtgccccaaaacagaagcacaagtaaataaaagaaatt

SEQ ID NO: 29530 - DNA, 2148 bp, Homo sapiens
ggggcagctgggatggtggcggagtccggaggcctcctgccgccgtcgggcagggaggccggcggaggcggggccgtggccgcccccgagaggcgcccaggcggcggcggcggcggcccagcttcttctttcctcgcacagccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaatgt

SEQ ID NO: 29531 - DNA, 2288 bp, Homo sapiens
ggcctccgccaacgcgccaccagttagaggcagggagtacctctccgagcggaagggccggcgtctccgaagcgcgggagcctccaaatcgcgcccttctgctctcacgagatctggtgacgtcagcgctcgctgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaatgt

SEQ ID NO: 29532 - DNA, 772 bp, Homo sapiens
gagaggcgcccaggcggcggcggcggcggcccagcttcttctttcctcgcacagccaggcggcccctgctcgagtcccgcgtcgccatggccgcggttcccgagttgctgcagcagcaggaggaggaccgcagcaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaa

SEQ ID NO: 29533 - DNA, 840 bp, Homo sapiens
gccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaag

SEQ ID NO: 29534 - DNA, 1855 bp, Homo sapiens
agggagatgcgcgcctgcgccggccctcgcctcggagcagccatgatggcctggacgacggcccggacttcctctcagaagaggaccgcggacttaaagcaataaatgtagatcttcaaagtgatgctgctctgcaggtggacatttctgatgctcttagtgagcgggataaagtaaaattcactgttcacacaaagagttcattgccaaattttaaacaaaacgagttttcagttgttcggcaacatgaggaatttatctggcttcatgattcctttgttgaaaatgaagactatgcaggttatatcattccaccagcaccaccaagacctgattttgatgcttcaagggaaaaactacagaagcttggtgaaggagaagggtcaatgacgaaggaagaattcacaaagatgaaacaggaactggaagcgggttggataacagagaaccttgggtttattctactgctacctccatcctctgcatccttcttttttgtcttcactgaatgactaccctcacagagatcaaacttctcccatcattggtcctgctggtttgctgtgaatatttggcaatattcaagaagacagttgcgatgcatgaagtgttcctgtgtcgtgtggcagcacatcctattttgagaagagatttaaatttccatgtcttcttggaatataatcaagatttgagtgtgcgaggaaaaaataaaaaagagaaacttgaagacttctttaaaaacatggttaaatcagcagatggagtaatcgtttcaggagtaaaggatgtagatgatttctttgagcacgaacgaacatttcttttggagtatcataaccgagttaaggatgcatctgctaaatctgatagaatgacaagatcccacaaaagtgctgcagatgattacaatagaattggttcttcattatatgctttaggaactcaggattctacagatatatgcaagttttttctcaaagtttcagaactgttcgataaaacaagaaaaatagaagcacgagtgtctgctgatgaagacctcaaactttctgatcttttaaaatattacttaagagaatctcaagctgctaaggatctcctgtatcgaaggtctaggtcactagtggattatgaaaatgctaataaagcactggataaagcaagagcaaaaaataaagatgttctacaggccgaaacttcccaacaattatgttgtcagaaatttgaaaaaatatctgagtctgcaaaacaagaacttatagattttaagacaagaagagttgctgcattcagaaaaaatttagtggaactggcagagttagaactgaagcatgcaaagggtaatctacagttgctgcagaactgcctggcagtgttaaatggagacacataagccacactccgccttcctgttaaaaagggctgccttccttcaaattttatttttgttttcttaatgatgttaagcatttatgctcactggaaacaaacaaaaagcagctgaaaaagtgcatcaactcctctttttctgagaaacatggagcagcgcacgcccaggcgatgccagtctgtgtgccgtgatgccgcactgtgttccccatgacagtggtccatcatcgtgcactcgtcatactcagaagtccaaagttcattcttctttaaagtagcctctataactctgtttattttataaatagtattccttatggctgccactcttatttacctttaaataatttctgaaatttaaccttttcagaatgcattgttgaaacaagataaagattgccttttttgaattttttaaattttgtttttaaaagcatataccaccttagttcattcatgtatcctg

SEQ ID NO: 29535 - DNA, 2001 bp, Homo sapiens
ctggccgccggctccctccggcagcagggagatgcgcgcctgcgccggccctcgcctcggagcagccatgatggaaggcctggacgacggcccggacttcctctcagaagaggaccgcggacttaaagcaataaatgtagatcttcaaagtgatgctgctctgcaggtggacatttctgatgctcttagtgagcgggataaagtaaaattcactgttcacacaaagagttcattgccaaattttaaacaaaacgagttttcagttgttcggcaacatgaggaatttatctggcttcatgattcctttgttgaaaatgaagactatgcaggttatatcattccaccagcaccaccaagacctgattttgatgcttcaagggaaaaactacagaagcttggtgaaggagaagggtcaatgacgaaggaagaattcacaaagatgaaacaggaactggaagctgaatatttggcaatattcaagaagacagttgcgatgcatgaagtgttcctgtgtcgtgtggcagcacatcctattttgagaagagatttaaatttccatgtcttcttggaatataatcaagatttgagtgtgcgaggaaaaaataaaaaagagaaacttgaagacttctttaaaaacatggttaaatcagcagatggagtaatcgtttcaggagtaaaggatgtagatgatttctttgagcacgaacgaacatttcttttggagtatcataaccgagttaaggatgcatctgctaaatctgatagaatgacaagatcccacaaaagtgctgcagatgattacaatagaattggttcttcattatatgctttaggaactcaggattctacagatatatgcaagttttttctcaaagtttcagaactgttcgataaaacaagaaaaatagaagcacgagtgtctgctgatgaagacctcaaactttctgatcttttaaaatattacttaagagaatctcaagctgctaaggatctcctgtatcgaaggtctaggtcactagtggattatgaaaatgctaataaagcactggataaagcaagagcaaaaaataaagatgttctacaggccgaaacttcccaacaattatgttgtcagaaatttgaaaaaatatctgagtctgcaaaacaagaacttatagattttaagacaagaagagttgctgcattcagaaaaaatttagtggaactggcagagttagaactgaagcatgcaaagggtaatctacagttgctgcagaactgcctggcagtgttaaatggagacacataagccacactccgccttcctgttaaaaagggctgccttccttcaaattttatttttgttttcttaatgatgttaagcatttatgctcactggaaacaaacaaaaagcagctgaaaaagtgcatcaactcctctttttctgagaaacatggagcagcgcacgcccaggcgatgccagtctgtgtgccgtgatgccgcactgtgttccccatgacagtggtccatcatcgtgcactcgtcatactcagaagtccaaagttcattcttctttaaagtagcctctataactctgtttattttataaatagtattccttatggctgccactcttatttacctttaaataatttctgaaatttaaccttttcagaatgcattgttgaaacaagataaagattgccttttttgaattttttaaattttgtttttaaaagcatataccaccttagttcattcatgtatcctggtaaagcatcttaatcagacttatttttaattactgaatatttcttagacgttttgggacagattttatgtaatctttataagtatgatttctgaagaaaagcaaatgcattagtatgtttgccttaaacttgtagactaaaccaagtattgtaaaataaacagcgataacagtgatagtttttaactctatggtcattgtatcactctggaaaatgtggagtagctgtaataaatctactcctgtattat

SEQ ID NO: 29536 - DNA, 3398 bp, Homo sapiens
tgggtgttctccgcggcgccgagtcccgggagcgcggtgggggcagcgggcgcggggcgggcgcggggaccgcgccagcctgtcactaatgtctccctttgtgtctcccccatctcatccttttccccggcgcgccgtgcccgccgaccccacaggaaggcctggacgacggcccggacttcctctcagaagaggaccgcggacttaaagcaataaatgtagatcttcaaagtgatgctgctctgcaggtggacatttctgatgctcttagtgagcgggataaagtaaaattcactgttcacacaaagagttcattgccaaattttaaacaaaacgagttttcagttgttcggcaacatgaggaatttatctggcttcatgattcctttgttgaaaatgaagactatgcaggttatatcattccaccagcaccaccaagacctgattttgatgcttcaagggaaaaactacagaagcttggtgaaggagaagggtcaatgacgaaggaagaattcacaaagatgaaacaggaactggaagctgaatatttggcaatattcaagaagacagttgcgatgcatgaagtgttcctgtgtcgtgtggcagcacatcctattttgagaagagatttaaatttccatgtcttcttggaatataatcaagatttgagtgtgcgaggaaaaaataaaaaagagaaacttgaagacttctttaaaaacatggttaaatcagcagatggagtaatcgtttcaggagtaaaggatgtagatgatttctttgagcacgaacgaacatttcttttggagtatcataaccgagttaaggatgcatctgctaaatctgatagaatgacaagatcccacaaaagtgctgcagatgattacaatagaattggttcttcattatatgctttaggaactcaggattctacagatatatgcaagttttttctcaaagtttcagaactgttcgataaaacaagaaaaatagaagcacgagtgtctgctgatgaagacctcaaactttctgatcttttaaaatattacttaagagaatctcaagctgctaaggatctcctgtatcgaaggtctaggtcactagtggattatgaaaatgctaataaagcactggataaagcaagagcaaaaaataaagatgttctacaggccgaaacttcccaacaattatgttgtcagaaatttgaaaaaatatctgagtctgcaaaacaagaacttatagattttaagacaagaagagttgctgcattcagaaaaaatttagtggaactggcagagttagaactgaagcatgcaaagggtaatctacagttgctgcagaactgcctggcagtgttaaatggagacacataagccacactccgccttcctgttaaaaagggctgccttccttcaaattttatttttgttttcttaatgatgttaagcatttatgctcactggaaacaaacaaaaagcagctgaaaaagtgcatcaactcctctttttctgagaaacatggagcagcgcacgcccaggcgatgccagtctgtgtgccgtgatgccgcactgtgttccccatgacagtggtccatcatcgtgcactcgtcatactcagaagtccaaagttcattcttctttaaagtagcctctataactctgtttattttataaatagtattccttatggctgccactcttatttacctttaaataatttctgaaatttaaccttttcagaatgcattgttgaaacaagataaagattgccttttttgaattttttaaattttgtttttaaaagcatataccaccttagttcattcatgtatcctggtaaagcatcttaatcagacttatttttaattactgaatatttcttagacgttttgggacagattttatgtaatctttataagtatgatttctgaagaaaagcaaatgcattagtatgtttgccttaaacttgtagactaaaccaagtattgtaaaataaacagcgataacagtgatagtttttaactctatggtcattgtatcactctggaaaatgtggagtagctgtaataaatctactcctgtattatgctttacagtgcaggtcttagtttttcttttttctcatttcttttgaaatggcatctcgaacaaagtccaccaatccctttacaaaagaatgaactgctcctctgtgtgtacttcatagaaggtggaatcggacagaggcaggttagtgacagttattcctgaaatacaggagcagagtacagtctgttgtggtttcccggattccgcgcctagctcagccaattaagcatgagacataggccattgagccacttagtagttatgcgagtggatagattggtatgtagagggaaagaggtctgctgtaaagaacaacacttgtttgtctgtggggaaagaaaagcagaatacttgagatgaaagttggcatacaaataggatactatcgccagtagttatattacaaacattatcggcctttctagtgtgaatgaacattagacacattattgtcattcctagtttaaagttaaggttgcgtggttggatttttccactatctttttctaatttttctaccatttggagaccgtaggcatttgggcctgtcaccccttggatgggttcctagtttgtttacattttcctgaaccctcctgagcgcccgttcttggtctaatccccagtcgtgatgattccacacttcctcagccgcatgttgtcttgcctcattcatgagctggtcagcgtttcgtctctttaactgacatgttccccagtgctgtttgaactgttgagtttccgttgctggctgagtgcgttttgtccttcacgtaaccttcgctggtaaaaataagcccatgtgatgtccaccagtggatgaatgctggaccgagagccctagcttctggatccaggtctaggcccttcatctgctgctctgtggcccagggcaggtttgcttgacctctgcctcagttctcgactctaaaggacatactgacctacctcacaggggtgttgtgaggattaataaatgttggtactctgctttggaaatgtgaaaatgctgtgtaaatgttaagaaatactaagtatagggccagaagctatacagtgtttcacttaaccgtttgccattctgtatttaccaaggtggtcttttctggggaaggaagtagagtggaaggtgcatcccttggcccctggtttacattattagggtgcttattgtaggaatgcactctaaaaagtgggcgtagaatgaaagcagccgtccagtggtcctcccttttctgtagtttcacttttcttgcttcaagttacagcagtcacctgaaatctgaaaatactaaatgaaaaactccagaaaca

SEQ ID NO: 29537 - DNA, 3017 bp, Homo sapiens
tgggtgttctccgcggcgccgagtcccgggagcgcggtgggggcagcgggcgcggggcgggcgcggggaccgcgccagcctgtcactaatgtctccctttgtgtctcccccatctcatccttttccccggcgcgccgtgcccgccgaccccacaggaaggcctggacgacggcccggacttcctctcagaagaggaccgcggacttaaagcaataaatgtagatcttcaaagtgatgctgctctgcaggtggacatttctgatgctcttagtgagcgggataaagtaaaattcactgttcacacaaagagttcattgccaaattttaaacaaaacgagttttcagttgttcggcaacatgaggaatttatctggcttcatgattcctttgttgaaaatgaagactatgcaggttatatcattccaccagcaccaccaagacctgattttgatgcttcaagggaaaaactacagaagcttggtgaaggagaagggtcaatgacgaaggaagaattcacaaagatgaaacaggaactggaagctgaatatttggcaatattcaagaagacagttgcgatgcatgaagtgttcctgtgtcgtgtggcagcacatcctattttgagaagagatttaaatttccatgtcttcttggaatataatcaagatttgagtgtgcgaggaaaaaataaaaaagagaaacttgaagacttctttaaaaacatggttaaatcagcagatggagtaatcgtttcaggagtaaaggatgtagatgatttctttgagcacgaacgaacatttcttttggagtatcataaccgagttaaggatgcatctgctaaatctgatagaatgacaagatcccacaaaagtgctgcagatgattacaatagaattggttcttcattatatgctttaggaactcaggattctacagatatatgcaagttttttctcaaagtttcagaactgttcgataaaacaagaaaaatagaagcacgagtgtctgctgatgaagacctcaaactttctgatcttttaaaatattacttaagagaatctcaagctgctaaggatctcctgtatcgaaggtctaggtcactagtggattatgaaaatgctaataaagcactggataaagcaagagcaaaaaataaagatgttctacaggccgaaacttcccaacaattatgttgtcagaaatttgaaaaaatatctgagtctgcaaaacaagaacttatagattttaagacaagaagagttgctgcattcagaaaaaatttagtggaactggcagagttagaactgaagcatgcaaagggtaatctacagttgctgcagaactgcctggcagtgttaaatggagacacataagccacactccgccttcctgttaaaaagggctgccttccttcaaattttatttttgttttcttaatgatgttaagcatttatgctcactggaaacaaacaaaaagcagctgaaaaagtgcatcaactcctctttttctgagaaacatggagcagcgcacgcccaggcgatgccagtctgtgtgccgtgatgccgcactgtgttccccatgacagtggtccatcatcgtgcactcgtcatactcagaagtccaaagttcattcttctttaaagtagcctctataactctgtttattttataaatagtattccttatggctgccactcttatttacctttaaataatttctgaaatttaaccttttcagaatgcattgttgaaacaagataaagattgccttttttgaattttttaaattttgtttttaaaagcatataccaccttagttcattcatgtatcctggtaaagcatcttaatcagacttatttttaattactgaatatttcttagacgttttgggacagattttatgtaatctttataagtatgatttctgaagaaaagcaaatgcattagtatgtttgccttaaacttgtagactaaaccaagtattgtaaaataaacagcgataacagtgatagtttttaactctatggtcattgtatcactctggaaaatgtggagtagctgtaataaatctactcctgtattatgctttacagtgcaggtcttagtttttcttttttctcatttcttttgaaatggcatctcgaacaaagtccaccaatccctttacaaaagaatgaactgctcctctgtgtgtacttcatagaaggtggaatcggacagaggcaggttagtgacagttattcctgaaatacaggagcagagtacagtctgttgtggtttcccggattccgcgcctagctcagccaattaagcatgagacataggccattgagccacttagtagttatgcgagtggatagattggtatgtagagggaaagaggtctgctgtaaagaacaacacttgtttgtctgtggggaaagaaaagcagaatacttgagatgaaagttggcatacaaataggatactatcgccagtagttatattacaaacattatcggcctttctagtgtgaatgaacattagacacattattgtcattcctagtttaaagttaaggttgcgtggttggatttttccactatctttttctaatttttacattttcctgaaccctcctgagcgcccgttcttggtctaatccccagtcgtgatgattccacacttcctcagccgcatgttgtcttgcctcattcatgagctggtcagcgtttcgtctctttaactgacatgttccccagtgctgtttgaactgttgagtttccgttgctggctgagtgcgttttgtccttcacgtaaccttcgctggtaaaaataagcccatgtgatgtccaccagtggatgaatgctggaccgagagccctagcttctggatccaggtctaggcccttcatctgctgctctgtggcccagggcaggtttgcttgacctctgcctcagttctcgactctaaaggacatactgacctacctcacaggggtgttgtgaggattaataaatgttggtactctgctttgg

SEQ ID NO: 29538 - DNA, 3562 bp, Homo sapiens
tggctatttctgttttttcctctggagtttgtttctctggctgtatgacttgcatgatacttaatccattctttctgtgctgcttatagttatttttagggtttcattaatactgtatcatgatgccaaacaacagactttagaaaatataatgcattgaagataacccattgctacacagttggggctttttgcatgtaatgtttgtgagtgagtggcatgctagagttttctggagaatttggtcctgccatgaatgtgctggttttagttaaaaactttgacctgctttttcactcttgttcactgggcaccttttttattttaaggtggatattttggctcagattggttgtgtcgaaagtctcagccagtcaccaccttcttctccttctccttctccttcttccatatataaggttggcagtggcaatgacccctggtcagcctggagtgcctccaaatctgggaactgggaaagctcagaaggctggggggcccagccagagggggctggagcccaaagaaacacaaacactcccaacaactgggacactgccttcggccacccccaggcctaccaaggaccagcaactggtgatgatgatgactgggatgaagactgggatgggcccaaatcctcttcctactttaaggattcagagtcagctgatgcaggcggcgctcagcgaggaaacagtcgtgctagttcctcatccatgaaaattccccttaacaaatttcctggatttgcgaaacctggcacggaacagtatttgttggccaaacaactagcaaaacccaaagagaaaattcccatcattgttggagattatggcccaatgtgggtttatcctacctctacttttgactgtgtggtagcagatcccaggaaaggctccaaaatgtatggtctaaagagctacatcgaatatcagctaacacctactaacactaatcgatctgtaaaccacaggtataagcactttgactggttatatgagcgtctcctggttaagtttgggtcagccattccaatcccttctcttccagacaaacaagtcacaggccgctttgaagaggaatttatcaaaatgcgcatggagagacttcaggcctggatgaccaggatgtgtcgccatccagtaatctcagaaagtgaagttttccagcagttcctaaatttccgagatgagaaggaatggaaaactggaaagaggaaggccgagagagatgagctggcgggagtcatgatattttccaccatggaaccagaggcacctgacttggacttagtagaaatagagcagaagtgcgaggctgtggggaagttcaccaaggccatggatgacggcgtgaaggagctgctgacggtggggcaggagcactggaagcgctgcacgggcccattacccaaggaatatcagaagataggaaaggccttgcagagtttggccacagtgttcagttccagtggctatcaaggtgaaacagatctcaatgatgcaataacagaagcaggaaagacttatgaagaaattgccagtctcgtggcagaacagccaaagaaagatctccatttcctgatggaatgtaatcacgagtataaaggttttcttggctgcttccctgacatcattggcactcacaagggagcaatagaaaaagtgaaagaaagtgacaaactagttgcaacaagtaaaatcaccctacaagacaaacagaacatggtgaagagagtcagcatcatgtcttacgcgttgcaagctgagatgaatcactttcacagtaaccggatctatgattacaacagtgtcatccgcctgtacctggagcagcaagtgcaattttacgaaacgattgcagaaaagctgaggcaggccctcagccgctttccagtgatgtaggacagaacgggccttgaagagaatgccgcgtgctttctcctgacttggggcaatgcaattcaaaactttttttcccctattattcagaaaaaaaaggaaacaaaaccaaaaagaaagagttgcaaaaaactgcatttattttattagccaccctaaatgcgtcagttatttagggatggtcttttgttcatttccgcatccattatttaaaccagtggaaattgtctctatttttggaaagtacttaaaagttaccagaattttcaatggaaaatgaggggtttctccccactgatattttacatagagtcataatttatatgtcttataaattataagtcttatataatttataagtctcccacaatcttccagttcttacccagtgtcagataattaattactaattactttcttaaaaacatgaactatgccagaataaaaaatatctatgtttgtatatttttataactcctttcagtcctctggggctcctgtcattgagggaagtcgttacgcctttcactgccacagttacagctcaagtgcttacacttcaagagggaggacgctgggggcccctggggctgctagtgccatcgtggtgtgtggcaggtgggccatcccatgtccctccagggggaccccacagcctggcagatgagcagatacccctggccacccatgtcctcagcgacatttctgatgtgctgctcttatgtgaggaccagtgctttctctctttgcacttccttcctaatcttggttaaggcatgttttatgccatgaagaatacattagaagaattgagggactttgtagagaattttgtggctttggtccaacgggtgagtggctgtgcggaggcctgtgttcgggagggcctgggagaaggagggcacccagcaccccggcgtctctggccctttcttattctttggctcctcatccaccgtgatgagaagcgctgctgtggccacggcacactgcttggcttgggtggcgggttcatggccagttggtgtcatcagcaaagagaaaaagcacaggttagctccccattagatggaaaagtgtagggactgagaagggctgcagcctcagcagtgtacagagtccccggcgctctgaggttggagagaaagaacagaccagcgcccttcccgactacatccgaaacttcacacagggtgtttctgagcaccagcacttccagcgcttcacttaacggcataaagcaaaacaggaccttggcacaccgtcagctcgaactcaacactggcagccaccgtctcacccctgcggaggagcgctcccgtctcccacaggtgccttaccgcgttccctcccgctgctttcatttttctgacctaataattacgggaaatggaaagtctgggccagcatcaataaaatgacaccaaaaataagtagatgaaatcaaatgaatatgagaacatcttgttcttcaatatcacgggtttttgttaatgtttcataagtaattctccccacttgatttttcttctataaaatcccatagaacaatgtttatgctatagccatttaatatatgtacaaattgtaaagaatatgtataaatgttttacacgaatgtaagagcatgtagaagccaacatataaataaattgttt

SEQ ID NO: 29539 - DNA, 4198 bp, Homo sapiens
agcggctgggcctgagcgtcgagactcggggccgaggcggaggagcggccgccgcgccggggcccagccggagccgccgccctcgcccttgcctttgcctgcgcggctcagaatcaccatccgcggcgcgggagacgagccggccgtcccgggccgggggacccgcccgccatggccaccaaggctcgggttatgtatgattttgctgctgaacctggaaataatgaactgacggttaatgaaggagaaatcatcacaatcacaaatccggatgtaggtggaggatggctggaaggaagaaacatcaaaggagaacgagggctggttcccacagactacgttgaaattttacccagtgatggaaaagatcaattttcttgtggaaattcagtggctgaccaagccttccttgattctctctcagccagcacagctcaggccagttcgtcggctgccagcaacaatcaccaggttggcagtggcaatgacccctggtcagcctggagtgcctccaaatctgggaactgggaaagctcagaaggctggggggcccagccagagggggctggagcccaaagaaacacaaacactcccaacaactgggacactgccttcggccacccccaggcctaccaaggaccagcaactggtgatgatgatgactgggatgaagactgggatgggcccaaatcctcttcctactttaaggattcagagtcagctgatgcaggcggcgctcagcgaggaaacagtcgtgctagttcctcatccatgaaaattccccttaacaaatttcctggatttgcgaaacctggcacggaacagtatttgttggccaaacaactagcaaaacccaaagagaaaattcccatcattgttggagattatggcccaatgtgggtttatcctacctctacttttgactgtgtggtagcagatcccaggaaaggctccaaaatgtatggtctaaagagctacatcgaatatcagctaacacctactaacactaatcgatctgtaaaccacaggtataagcactttgactggttatatgagcgtctcctggttaagtttgggtcagccattccaatcccttctcttccagacaaacaagtcacaggccgctttgaagaggaatttatcaaaatgcgcatggagagacttcaggcctggatgaccaggatgtgtcgccatccagtaatctcagaaagtgaagttttccagcagttcctaaatttccgagatgagaaggaatggaaaactggaaagaggaaggccgagagagatgagctggcgggagtcatgatattttccaccatggaaccagaggcacctgacttggacttagtagaaatagagcagaagtgcgaggctgtggggaagttcaccaaggccatggatgacggcgtgaaggagctgctgacggtggggcaggagcactggaagcgctgcacgggcccattacccaaggaatatcagaagataggaaaggccttgcagagtttggccacagtgttcagttccagtggctatcaaggtgaaacagatctcaatgatgcaataacagaagcaggaaagacttatgaagaaattgccagtctcgtggcagaacagccaaagaaagatctccatttcctgatggaatgtaatcacgagtataaaggttttcttggctgcttccctgacatcattggcactcacaagggagcaatagaaaaagtgaaagaaagtgacaaactagttgcaacaagtaaaatcaccctacaagacaaacagaacatggtgaagagagtcagcatcatgtcttacgcgttgcaagctgagatgaatcactttcacagtaaccggatctatgattacaacagtgtcatccgcctgtacctggagcagcaagtgcaattttacgaaacgattgcagaaaagctgaggcaggccctcagccgctttccagtgatgtaggacagaacgggccttgaagagaatgccgcgtgctttctcctgacttggggcaatgcaattcaaaactttttttcccctattattcagaaaaaaaaggaaacaaaaccaaaaagaaagagttgcaaaaaactgcatttattttattagccaccctaaatgcgtcagttatttagggatggtcttttgttcatttccgcatccattatttaaaccagtggaaattgtctctatttttggaaagtacttaaaagttaccagaattttcaatggaaaatgaggggtttctccccactgatattttacatagagtcataatttatatgtcttataaattataagtcttatataatttataagtctcccacaatcttccagttcttacccagtgtcagataattaattactaattactttcttaaaaacatgaactatgccagaataaaaaatatctatgtttgtatatttttataactcctttcagtcctctggggctcctgtcattgagggaagtcgttacgcctttcactgccacagttacagctcaagtgcttacacttcaagagggaggacgctgggggcccctggggctgctagtgccatcgtggtgtgtggcaggtgggccatcccatgtccctccagggggaccccacagcctggcagatgagcagatacccctggccacccatgtcctcagcgacatttctgatgtgctgctcttatgtgaggaccagtgctttctctctttgcacttccttcctaatcttggttaaggcatgttttatgccatgaagaatacattagaagaattgagggactttgtagagaattttgtggctttggtccaacgggtgagtggctgtgcggaggcctgtgttcgggagggcctgggagaaggagggcacccagcaccccggcgtctctggccctttcttattctttggctcctcatccaccgtgatgagaagcgctgctgtggccacggcacactgcttggcttgggtggcgggttcatggccagttggtgtcatcagcaaagagaaaaagcacaggttagctccccattagatggaaaagtgtagggactgagaagggctgcagcctcagcagtgtacagagtccccggcgctctgaggttggagagaaagaacagaccagcgcccttcccgactacatccgaaacttcacacagggtgtttctgagcaccagcacttccagcgcttcacttaacggcataaagcaaaacaggaccttggcacaccgtcagctcgaactcaacactggcagccaccgtctcacccctgcggaggagcgctcccgtctcccacaggtgccttaccgcgttccctcccgctgctttcatttttctgacctaataattacgggaaatggaaagtctgggccagcatcaataaaatgacaccaaaaataagtagatgaaatcaaatgaatatgagaacatcttgttcttcaatatcacgggtttttgttaatgtttcataagtaattctccccacttgatttttcttctataaaatcccatagaacaatgtttatgctatagccatttaatatatgtacaaattgtaaagaatatgtataaatgttttacacgaatgtaagagcatgtagaagccaacatataaataaattgtttaaaaaaactgtacagtaaattctcaaagcactttttcaaaacactttttggactttgtgtgtgatttttgttgttgttgttaagtactttttattccagctgctgaaaatggtccaggtaatgaattcttccccaaatcctatttcttctgacatgaattcatcatttcagttccgtaggtcagtgttgcggtccgggaagcgtatcataaccacctgggagttgccaagaagcagacagtctcccagtgtctgactctcggatatttggatttgactggtgtgaggcaaagtgaaaaagggatgggggaaatggagatggcacgggctcctcagagcgtggtagccgactgtgaggaaaagcagagggaatgtgaaagaaaataagagaatccacgggatttgatgcctggaagattctccttcaagtggcaacatggcatatatatccttctccggggagtcacatgcaccatttggttcttagatacgttgatgttttgatttttaatgatttgtatcaacctgtaggtaccacagaagagctgtagtcatacaatcacataacttttacaaatatagtgg

SEQ ID NO: 29540 - DNA, 1886 bp, Homo sapiens
agtagccgagcgcccttgcctttgcctgcgcggctcagaatcaccatccgcggcgcgggagacgagccggccgtcccgggccgggggacccgcccgccatggccaccaaggctcgggttatgtatgattttgctgctgaacctggaaataatgaactgacggttaatgaaggagaaatcatcacaatcacaaatccggatgtaggtggaggatggctggaaggaagaaacatcaaaggagaacgagggctggttcccacagactacgttgaaattttacccagtgatggaaaagatcaattttcttgtggaaattcagtggctgaccaagccttccttgattctctctcagccagcacagctcaggccagttcgtcggctgccagcaacaatcaccaggttggcagtggcaatgacccctggtcagcctggagtgcctccaaatctgggaactgggaaagctcagaaggctggggggcccagccagagggggctggagcccaaagaaacacaaacactcccaacaactgggacactgccttcggccacccccaggcctaccaaggaccagcaactggtgatgatgatgactgggatgaagactgggatgggcccaaatcctcttcctactttaaggattcagagtcagctgatgcaggcggcgctcagcgaggaaacagtcgtgctagttcctcatccatgaaaattccccttaacaaatttcctggatttgcgaaacctggcacggaacagtatttgttggccaaacaactagcaaaacccaaagagaaaattcccatcattgttggagattatggcccaatgtgggtttatcctacctctacttttgactgtgtggtagcagatcccaggaaaggctccaaaatgtatggtctaaagagctacatcgaatatcagctaacacctactaacactaatcgatctgtaaaccacaggtataagcactttgactggttatatgagcgtctcctggttaagtttgggtcagccattccaatcccttctcttccagacaaacaagtcacaggccgctttgaagaggaatttatcaaaatgcgcatggagagacttcaggcctggatgaccaggatgtgtcgccatccagtaatctcagaaagtgaagttttccagcagttcctaaatttccgagatgagaaggaatggaaaactggaaagaggaaggccgagagagatgagctggcgggagtcatgatattttccaccatggaaccagaggcacctgacttggacttagtagaaatagagcagaagtgcgaggctgtggggaagttcaccaaggccatggatgacggcgtgaaggagctgctgacggtggggcaggagcactggaagcgctgcacgggcccattacccaaggaatatcagaagataggaaaggccttgcagagtttggccacagtgttcagttccagtggctatcaaggtgaaacagatctcaatgatgcaataacagaagcaggaaagacttatgaagaaattgccagtctcgtggcagaacagccaaagaaagatctccatttcctgatggaatgtaatcacgagtataaaggttttcttggctgcttccctgacatcattggcactcacaagggagcaatagaaaaagtgaaagaaagtgacaaactagttgcaacaagtaaaatcaccctacaagacaaacagaacatggtgaagagagtcagcatcatgtcttacgcgttgcaagctgagatgaatcactttcacagtaaccggatctatgattacaacagtgtcatccgcctgtacctggagcagcaagtgcaattttacgaaacgattgcagaaaagctgaggcaggccctcagccgctttccagtgatgtag

SEQ ID NO: 29541 - DNA, 1308 bp, Homo sapiens
atgggattgtctttttccctttttccccttaggaaccacgtgaatgttgagggggcgacacacaagcaggtggtggacctgattcgagcaggcgagaaggaattgatcttgacagtgttatctgtacctcctcatgaggcagataacctagatcccagtgacgactcgttgggacaatcattttatgattacacagaaaagcaagcagtgcccatatcggtccccagatacaaacatgtggagcagaatggtgagaagtttgtggtatataatgtttacatggcagggaggcagctgtgttctaagcggtaccgggagtttgctatcctacaccagaacctgaagagagagtttgccaactttacatttcctcgactcccagggaagtggccattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcagctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagaggaatattag

SEQ ID NO: 29542 - DNA, 7197 bp, Homo sapiens
tcccgcggccggcggatcgggcgcgcgcgtcgggggtcgtccggctgccaggcagggcgagcacgcgccgggaggccttggaggcgtagggggcgggggtacggctcgcctgctcgcaagatggcggacgaggacggggaagggattcatccctcagcccctcacaggaacggaggtggcggcggcggcggggggtctgggctccactgcgccgggaacggcggcgggggaggcggcggcccgcgggtcgtgcgcatcgtcaagtccgagtccggctacggcttcaacgtgcggggccaagtgagcgagggcgggcaactgcggagcatcaacggggagctgtacgcgccgctgcagcatgtgagcgccgtgctgcccgggggggcggccgatcgggccggggtgcgcaagggggaccgcatcctggaggtgaaccacgtgaatgttgagggggcgacacacaagcaggtggtggacctgattcgagcaggcgagaaggaattgatcttgacagtgttatctgtacctcctcatgaggcagataacctagatcccagtgacgactcgttgggacaatcattttatgattacacagaaaagcaagcagtgcccatatcggtccccagatacaaacatgtggagcagaatggtgagaagtttgtggtatataatgtttacatggcagggaggcagctgtgttctaagcggtaccgggagtttgctatcctacaccagaacctgaagagagagtttgccaactttacatttcctcgactcccagggaagtggccattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcagctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagaggaatattagttagagactgattatctcatgtgagccaggacattcttccagcaaggttggcctctggatggtgaacgggctgtgcaaaaaagccctgcttcttcccttgtctagagggtggacattggctacaggctcttccatctctcatgacttcatggaccctcctctgccagttttttaaatcagatcaccctccatgttgttcctgacccacaggggaagctgtcctcagttgtagccgtcttgactggatgagtcctggcagtctttctaggcgaaccaagaatgtttgtgtgagggaaggtgtttgctgttgctttactgctgtctgtatgtgccagtgctggaacagaatttggaagattctgaataattagttacttattctcaaagaaaatctttgaaagaatcaggaggtcaagtcaagaacatgaaaatttatattttagtacagtagaaagaacattgggctctgggaattttatctgggttttctcctggcttttttttccctctgtgtaattttgggtaaatcagcctccctagctttcagttttctcttctgtgaaacaggaagactgaaccacgtaattaatatccaaggtcccttccggctctaaaaggctatgattctagatgagaagttatatcaagaaagatgtggccaatcagattgagtcatccaggcatacctttttagcttctgtttgtggagttgtctccagataagaggagatgtgccttcccaataactctttttttttttcctttcagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctcactcctggctttctagccacattctgcacctccttcctgctttcctagagcctcggtatgctttccctcaaccgaccctggctcaggaggttgatgccatgggaacctgaacctgaaacacttcatggtagtaatttcctgttttccttgccttttttttttttttttttttttttttctgagacagggtcttactctgtcgcccagactggaatgtggtggcatgaacatagctcactgttaccttgaattctgggctcaggtgatccttccgcctcaccctcctgagtagctgggactacaggtgtgcaccaccacacctggctaattcttcttaaaatttttttgtagagacagggtctcactatgttgcccaggctggtctcaaactcctggcctcaggtgatcctcttgtctcagcctcccaaagtgctgggattacaggcatgagccactgtgtccttccctgccttttttgcagcagggatagtactcaggaccagagttaagctgataccttaggcacacaggttggacttacatagaggaaagaaagcaagaaatgccctatgtacatgaggttttacctcctccattcctgaccaataaccacccataactacggcattctctgtgacttccttaaacagcagtgatgggaagggatccaatagtatcttcaaggccttggggaaacttgcagtgggtcagtggtctgtgccaaccaaacgatagccccatccaagccagctgagaacctaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaaagtctcttttttgtaatttgtttttgcaaatcattgtgaggccactttttctttctttctttctttctttctttctttctttctttctttcgttctttcgttctttcgttctttctttctttctttctttctctttctttcttttgctttccttctttcatctcttttttgtaatttgttgttgcaaatcattgtgaggccacttttctttccccttccttccttcctttttttctgttttttttttttttttttcccagagtcttgctctgtcgcccaggttggagtgcagtggcacgatctcggctcactgcaccctctgcctcttgggttcaagcgattctcctgcctcagcctcccaagtagctgggattacaggcatacaccaccacgccccactaattttttgtatttttggtagggcggggtttcaccatgatggccaggttggttttgaactcctgacctcaagtaatctgcccacctcggcctcccaaagtgctaggattacaggagtgagccactgcgcctggcccacttttctttctttccttcttattttgttatgctggcagccatttgcccctgcatggtatgggatcaaagaggacagcctttcctccctcaccttctccaaatctaggtgaaatcacagagtacaaaacgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacagcttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaacgcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctcttgacttcctgttcccctaaacctgagcacatcacgccaggcctctttgctgccaggacagcatcagctcactcctcagcaataatctagggtatgtgggaaggtcagggctgtggtaaggaatagaatcaaagaggggagtgatacggggtgggggcacttggccgcctgctaaacttggacattaattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgatcaaacacttctttggtt

SEQ ID NO: 29543 - DNA, 6403 bp, Homo sapiens
tcccgcggccggcggatcgggcgcgcgcgtcgggggtcgtccggctgccaggcagggcgagcacgcgccgggaggccttggaggcgtagggggcgggggtacggctcgcctgctcgcaagatggcggacgaggacggggaagggattcatccctcagcccctcacaggaacggaggtggcggcggcggcggggggtctgggctccactgcgccgggaacggcggcgggggaggcggcggcccgcgggtcgtgcgcatcgtcaagtccgagtccggctacggcttcaacgtgcggggccaagtgagcgagggcgggcaactgcggagcatcaacggggagctgtacgcgccgctgcagcatgtgagcgccgtgctgcccgggggggcggccgatcgggccggggtgcgcaagggggaccgcatcctggaggtgaaccacgtgaatgttgagggggcgacacacaagcaggtggtggacctgattcgagcaggcgagaaggaattgatcttgacagtgttatctgtacctcctcatgaggcagataacctagatcccagtgacgactcgttgggacaatcattttatgattacacagaaaagcaagcagtgcccatatcggtccccagatacaaacatgtggagcagaatggtgagaagtttgtggtatataatgtttacatggcagggaggcagctgtgttctaagcggtaccgggagtttgctatcctacaccagaacctgaagagagagtttgccaactttacatttcctcgactcccagggaagtggccattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcagctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctcactcctggctttctagccacattctgcacctccttcctgctttcctagagcctcggtatgctttccctcaaccgaccctggctcaggaggttgatgccatgggaacctgaacctgaaacacttcatggtagtaatttcctgttttccttgccttttttttttttttttttttttttttctgagacagggtcttactctgtcgcccagactggaatgtggtggcatgaacatagctcactgttaccttgaattctgggctcaggtgatccttccgcctcaccctcctgagtagctgggactacaggtgtgcaccaccacacctggctaattcttcttaaaatttttttgtagagacagggtctcactatgttgcccaggctggtctcaaactcctggcctcaggtgatcctcttgtctcagcctcccaaagtgctgggattacaggcatgagccactgtgtccttccctgccttttttgcagcagggatagtactcaggaccagagttaagctgataccttaggcacacaggttggacttacatagaggaaagaaagcaagaaatgccctatgtacatgaggttttacctcctccattcctgaccaataaccacccataactacggcattctctgtgacttccttaaacagcagtgatgggaagggatccaatagtatcttcaaggccttggggaaacttgcagtgggtcagtggtctgtgccaaccaaacgatagccccatccaagccagctgagaacctaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaaagtctcttttttgtaatttgtttttgcaaatcattgtgaggccactttttctttctttctttctttctttctttctttctttctttctttcgttctttcgttctttcgttctttctttctttctttctttctctttctttcttttgctttccttctttcatctcttttttgtaatttgttgttgcaaatcattgtgaggccacttttctttccccttccttccttcctttttttctgttttttttttttttttttcccagagtcttgctctgtcgcccaggttggagtgcagtggcacgatctcggctcactgcaccctctgcctcttgggttcaagcgattctcctgcctcagcctcccaagtagctgggattacaggcatacaccaccacgccccactaattttttgtatttttggtagggcggggtttcaccatgatggccaggttggttttgaactcctgacctcaagtaatctgcccacctcggcctcccaaagtgctaggattacaggagtgagccactgcgcctggcccacttttctttctttccttcttattttgttatgctggcagccatttgcccctgcatggtatgggatcaaagaggacagcctttcctccctcaccttctccaaatctaggtgaaatcacagagtacaaaacgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacagcttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaacgcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctcttgacttcctgttcccctaaacctgagcacatcacgccaggcctctttgctgccaggacagcatcagctcactcctcagcaataatctagggtatgtgggaaggtcagggctgtggtaaggaatagaatcaaagaggggagtgatacggggtgggggcacttggccgcctgctaaacttggacattaattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgat

SEQ ID NO: 29544 - DNA, 3882 bp, Homo sapiens
gtattgcacaaacaagtggacacccgggagctggccctgctcgtcccctgggccctccttccctggtcctgcaggtcttgctgcttgtcaggcctctcctccaaccctctgccacatttcagaaaagctgagaatcccttggagtgaaaaaggaggagaaacacagtgtccgtagcccagaaggaggttaaatactttcacttctcttttccccatttgggcggagccctttctgagtcagtctgtcggccgacttcctgcttggggcctgggcagccacactgcacgcaggctgggccgactgaggggctcagaggccaggctctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcgagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggatcacagccacaagaacctgaaaataagaagtgctcctgtgtcatgtgttttccaaaaggtgtgccaagaagccaagaagcaaggactgaaagtagtcaagcatctgacatgatggataccatggatgttgaaaacaattctactttggaaaaacacagtgggaaaagaagaaaaaagagaaggcatagatctaaagtaaatggtctccaaagagggagaaagaaagacagacctagaaaacatttaactctgaataacaaagtccaaaagaaaagatggcaacaaagaggaagaaaagccaacactagacctttgaaaagaagaagaaaaagaggtccaagaattcccaaagatgaaaatattaattttaaacaatctgaacttcctgtgacctgtggtgaggtgaagggcactctatataaggagcgattcaaacaaggaacctcaaagaagtgtatacagagtgaggataaaaagtggttcactcccagggaatttgaaattgaaggagaccgcggagcatccaagaactggaagctaagtatacgctgcggtggatataccctgaaagtcctgatggagaacaaatttctgccagaaccaccaagcacaagaaaaaagagaatactggaatctcacaacaataccttagttgacccttgtgaggagcataagaagaagaacccagatgcttcagtcaagttctcagagtttttaaagaagtgctcagagacatggaagaccatttttgctaaagagaaaggaaaatttgaagatatggcaaaggcggacaaggcccattatgaaagagaaatgaaaacctatatccctcctaaaggggagaaaaaaaagaagttcaaggatcccaatgcacccaagaggcctcctttggcctttttcctgttctgctctgagtatcgcccaaaaatcaaaggagaacatcctggcctgtccattgatgatgttgtgaagaaactggcagggatgtggaataacaccgctgcagctgacaagcagttttatgaaaagaaggctgcaaagctgaaggaaaaatacaaaaaggatattgctgcatatcgagctaaaggaaagcctaattcagcaaaaaagagagttgtcaaggctgaaaaaagcaagaaaaagaaggaagaggaagaagatgaagaggatgaacaagaggaggaaaatgaagaagatgatgataaataagttgcttctagtgcagtttttttcttgtctataaagcatttaagctgcctgtacacaactcactccttttaaagaaaaaaacttcaacgtaagactgtgtaagatttgtttttaaaccgtacactgtgtttttttgtatagttaaccactaccgaatgtgtcttcagatagccctgtcctggtggtatttagccactaacctttgcctggtacagtatgggggttgtaaattggcatggaaatttaaagcaggttcttgttagtgcacagcacaaattagttgtatatgaggatggtagttttttcaccttcagttgtctctgatgtagcttatacaaaacatttgttgttctgttaactgaatgccactctgtaattgcaaaaaaaaaaaacagttgcagctgttttgttgacattctgaatgcttctaagtaaatacaatttttaaaaaaccgtatgagggaactgtgtagacaaggtaccaggtcagtcttcttccatgtctattagctccacaaagccaatctcaatccctcaaaacaatcttgtcatacttgaaaatatgacactctagtcaaagccttggtaaaataatcagtgtttccaatctgtcctgttacaaaagaaacagattattattgaacttatgcaaataaccattgtcataagaatgtttatgaatagtttccaaattatggcaaattcatgtagagagagaaaagtaactgttttggttttgctcacaaaagtctactttacctaagggctgtcagatataagtaacttaaaagaaagagaagttttcttgacttttgaaaacaaaatatgaaaagaatcggcaatgtttcaaacaaaaagtcataaaagtcactttattcctccatcaa

SEQ ID NO: 29545 - DNA, 2926 bp, Homo sapiens
ctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcgagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggatcacagccacaagaacctgaaaataagaagtgctcctgtgtcatgtgttttccaaaaggtgtgccaagaagccaagaagcaaggactgaaagtagtcaagcatctgacatgatggataccatggatgttgaaaacaattctactttggaaaaacacagtgggaaaagaagaaaaaagagaaggcatagatctaaagtaaatggtctccaaagagggagaaagaaagacagacctagaaaacatttaactctgaataacaaagtccaaaagaaaagatggcaacaaagaggaagaaaagccaacactagacctttgaaaagaagaagaaaaagaggtccaagaattcccaaagatgaaaatattaattttaaacaatctgaacttcctgtgacctgtggtgaggtgaagggcactctatataaggagcgattcaaacaaggaacctcaaagaagtgtatacagagtgaggataaaaagtggttcactcccagggaatttgaaattgaaggagaccgcggagcatccaagaactggaagctaagtatacgctgcggtggatataccctgaaagtcctgatggagaacaaatttctgccagaaccaccaagcacaagaaaaaagagaatactggaatctcacaacaataccttagttgacccttgtccggaaaactcaaatatatgtgaggtgtgcaacaaatggggacggctgttctgctgcgacacttgtccaagatcctttcatgagcactgccacatcccatccgtggaagctaacaagaacccgtggagttgcatcttctgcaggataaagactattcaggaaagatgcccagaaagccaatcaggtcatcaggaatctgaagtcctgatgaggcagatgctgcctgaggagcagttgaaatgtgaattcctcctcttgaaggtctactgtgattcgaaaagctgctttttcgcctcagaaccgtattataacagagaggggtctcagggcccacagaagcccatgtggttaaacaaagtcaagacaagtttgaatgagcagatgtacacccgagtagaagggtttgtgcaggacatgcgtctcatctttcataaccacaaggaattttacagggaagataaattcaccagactgggaattcaagtacaggacatctttgagaagaatttcagaaacatttttgcaattcaggaaacaagcaagaacattataatgtttatttagccattcttatctcctcccttcagatcctctggcagctagctacgcaatgtgcctgtggtcccactaatctgtgactgctcctgtggaaactccacatcacaattctccaaaatttatcattgccattttaaaaccgtcttttcagctttcaataaaattcaacaccccttcatgttaaaaattctcaataagctaggtattgaggaacatatcccaaaataataagagccatttatg

SEQ ID NO: 29546 - DNA, 1453 bp, Homo sapiens
ctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcgagcggggcactgagaagcaagcatggtgagaaggctcctatgacttctagaagtacatctacttggagaatacccagcaggaagagacaattaaaaaaaaaaaagaagaagaaacaatgtcatccccagccccagcctcagagagggctcctggagcaatcttga

SEQ ID NO: 29547 - DNA, 2198 bp, Homo sapiens
ctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcgagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggatcacagccacaagaacctgaaaataagaagtgctcctgtgtcatgtgttttccaaaaggtgtgccaagaagccaagaagcaaggactgaaagtagtcaagcatctgacatgatggataccatggatgttgaaaacaattctactttggaaaaacacagtgggaaaagaagaaaaaagagaaggcatagatctaaagtaaatggtctccaaagagggagaaagaaagacagacctagaaaacatttaactctgaataacaaagtccaaaagaaaagatggcaacaaagaggaagaaaagccaacactagacctttgaaaagaagaagaaaaagaggtccaagaattcccaaagatgaaaatattaattttaaacaatctgaacttcctgtgacctgtggtgaggtgaagggcactctatataaggagcgattcaaacaaggaacctcaaagaagtgtatacagagtgaggataaaaagtggttcactcccagggaatttgaaattgaaggagaccgcggagcatccaagaactggaagctaagtatacgctgcggtggatataccctgaaagtcctgatggagaacaaatttctgccagaaccaccaagcacaagaaaaaaggtgatgatcaagtgatcttctgccaatgtctcgtctattatgttgttgattttctatctctgtggacttacagtctttaaattgacccatcatcataaaatttgattttataata

SEQ ID NO: 29548 - DNA, 1898 bp, Homo sapiens
ggggctcagaggccaggctctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcgagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattcttttttttaaacctgctctcattcctattaacactaagatcttagatttttatagtgataaatgggttgacatcattgtcatttgtaattgtaaagcctcaaaagacaactgttcctactatgtaattatagacagaaataaaaacttcagatc

SEQ ID NO: 29549 - DNA, 2650 bp, Homo sapiens
ctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcgagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggatcacagccacaagaacctgaaaataagaagtgctcctgtgtcatgtgttttccaaaaggtgtgccaagaagccaagaagcaaggactgaaagtagtcaagcatctgacatgatggataccatggatgttgaaaacaattctactttggaaaaacacagtgggaaaagaagaaaaaagagaaggcatagatctaaagtaaatggtctccaaagagggagaaagaaagacagacctagaaaacatttaactctgaataacaaagtccaaaagaaaagatggcaacaaagaggaagaaaagccaacactagacctttgaaaagaagaagaaaaagaggtccaagaattcccaaagatgaaaatattaattttaaacaatctgaacttcctgtgacctgtggtgaggtgaagggcactctatataaggagcgattcaaacaaggaacctcaaagaagtgtatacagagtgaggataaaaagtggttcactcccagggaatttgaaattgaaggagaccgcggagcatccaagaactggaagctaagtatacgctgcggtggatataccctgaaagtcctgatggagagaatactggaatctcacaacaataccttagttgacccttgtccggaaaactcaaatatatgtgaggtgtgcaacaaatggggacggctgttctgctgcgacacttgtccaagatcctttcatgagcactgccacatcccatccgtggaagctaacaagaacccgtggagttgcatcttctgcaggataaagactattcaggaaagatgcccagaaagccaatcaggtcatcaggaatctgaagtcctgatgaggcagatgctgcctgaggagcagttgaaatgtgaattcctcctcttgaaggtctactgtgattcgaaaagctgctttttcgcctcagaaccgtattataacagagaggggtctcagggcccacagaagcccatgtggttaaacaaagtcaagacaagtttgaatgagcagatgtacacccgagtagaagggtttgtgcaggacatgcgtctcatctttcataaccacaaggaattttacagggaagataaattcaccagactgggaattcaagtacaggacatctttgagaagaatttcagaaacatttttgcaattcaggaaacaagcaagaacattataatgtttatttag

SEQ ID NO: 29550 - DNA, 1846 bp, Homo sapiens
cacactgcacgcaggctgggccgactgaggggctcagaggccaggctctgaggcccacgcagggcctagggtgggaagatggcaggtgggggcggcgacctgagcaccaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcgagcggggcactgagaagcaagcatgctcctatgacttctagaagtacatctacttggagaatacccagcaggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattcttttttttaaacctgctctcattcctattaacactaagatcttagatttttatagtgataaatgggttgacatcattgtcatttgtaattgtaaagcctcaaaagacaactgttcctactatgtaattatagacagaaataaaaacttcagatcaaac

SEQ ID NO: 29551 - DNA, 2037 bp, Homo sapiens
agacgctgtggtctcacctgtcctggcaaggggcctctgccggctgttcccatgactggctcagggtctgagttcttattccatcaaccttgatcaaaagaaggaaagggaagaaaaaggcccagggaggctgaatgaatgtatttcaccagtagcaaatgagatgaaccatcttcctgcacacagccacgatttgcaaaggtttttggagaggaataaatttaatgaaagatgtacatgacttctaaaaactataagcagtgctgggtaaaattaaacacatgatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcgagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattcttttttttaaacctgctctcattcctattaacactaagatcttagatttttatagtgataaatgggttgacatcattgtcatttgtaattgtaaagcctcaaaagacaactgttcctactatgtaattatagacagaaataaaaacttcagatcaaacactctcaaa

SEQ ID NO: 29552 - DNA, 2426 bp, Homo sapiens
gtaactctcccaatcttgaggagtgatccctgtcccagcccctggaaaggggcaggaacgacaaactcaaagtccaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaggagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagattgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagcggaaaaactcggatgaatgcgaggtgtgctgtcaagggggacaacttctctgctgcggtacttgtccacgagtcttccatgaggactgtcacatcccccctgtggaagccaagaggatgctgtggagttgcaccttctgcaggatgaagaggtcttcaggaagccaacagtgccatcatgtatctaagaccctggagaggcagatgcagcctcaggaccagctgaaatgtgagttcctcctcttgaaggcctactgtcatccacaaagctccttttttacgggcatcccatttaatattcgagattacggtgagccctttcaggaagcaatgtggttggacctggttaaggaaaggctgattacggaaatgtacacggtggcatggtttgtgcgagacatgcgcctgatgtttcgcaaccataaaacattttacaaggcttctgactttggccaggtaggacttgacttagaggcagaatttgaaaaagatctcaaagacgtgctcggttttcatgaagccaatgacggcggtttctggactcttccttgaccctgttctgtaaagactgaagcatccccacctcaggattcagctgatgggaccctggcttggactgttgattgccagtgagtctgggatgtaattggctgccctcaggacccaaacccagacacttcataggattatcacaccctccatctttattctttctttttacctttaaaagtctatatctacactaaaaaaaaaaaaaa

SEQ ID NO: 29553 - DNA, 2080 bp, Homo sapiens
aagtgcccatgaggaggtggagagaggctgcaggcaccgacctgccttcagcttccggcttggcaaactccgaaaactttcacttttcttttctcggaagcccggccccttactgcgtttgtcaaagcacagacttcctgttttgcctgctagcatctccctgtaactctcccaatcttgaggagtgatccctgtcccagcccctggaaaggggcaggaacgacaaactcaaagtccaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaggagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagattgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagagtggacttttgctctgtcctccaagaataaatctcaagagagagttaaatagcaagtgaatttctactaccctctcagtcaccatgttgcagactttccctgtctggaggctcaccttagagcttctgagtttccaagctctgagtcacctccacatttgggcatggcatcttcaaaacaattaatttgcatagttaatttgggatggggaagcaaatgactctaaaataaaaattaaatgaaaaagct

SEQ ID NO: 29554 - DNA, 1740 bp, Homo sapiens
aagtgcccatgaggaggtggagagaggctgcaggcaccgacctgccttcagcttccggcttggcaaactccgaaaactttcacttttcttttctcggaagcccggccccttactgcgtttgtcaaagcacagacttcctgttttgcctgctagcatctccctgtaactctcccaatcttgaggagtgatccctgtcccagcccctggaaaggggcaggaacgacaaactcaaagtccaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaggagagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagattgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagagtggacttttgctctgtcctccaagaataaatctcaagagagagttaaatagcaagtga

SEQ ID NO: 29555 - DNA, 2337 bp, Homo sapiens
tgtaactctcccaatcttgaggagtgatccctgtcccagcccctggaaaggggcaggaacgacaaactcaaagtccaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaggagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagattgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagcggaaaaactcggatgaatgcgaggtgtgctgtcaagggggacaacttctctgctgcggtacttgtccacgagtcttccatgaggactgtcacatcccccctgtggaagccaagaggatgctgtggagttgcaccttctgcaggatgaagaggtcttcaggaagccaacagtgccatcatgtatctaagaccctggagaggcagatgcagcctcaggaccagctgattcgagattacggtgagccctttcaggaagcaatgtggttggacctggttaaggaaaggctgattacggaaatgtacacggtggcatggtttgtgcgagacatgcgcctgatgtttcgcaaccataaaacattttacaaggcttctgactttggccaggtaggacttgacttagaggcagaatttgaaaaagatctcaaagacgtgctcggttttcatgaagccaatgacggcggtttctggactcttccttgaccctgttctgtaaagactgaagcatccccacctcaggattcagctgatgggaccctggcttggactgttgattgccagtgagtctgggatgtaattggctgccctcaggacccaaacccagacacttcataggattatcacaccctccatctttattctttctttttacctttaaaagtctatatcta

SEQ ID NO: 29556 - DNA, 1937 bp, Homo sapiens
gttttgcctgctagcatctccctgtaactctcccaatcttgaggagtgatccctgtcccagcccctggaaaggggcaggaacgacaaactcaaagtccaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaggagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagattgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagagtggacttttgctctgtcctccaagaataaatctcaagagagagttaaatagcaagtgaatttctactaccctctcagtcaccatgttgcagactttccctgtctggaggctcaccttagagcttctgagtttccaagctctgagtcacctccacatttgggcatggcatcttcaaaacaattaatttgcatagttaatttgggatggggaagcaaatgactctaaaataaaaattaaatgaaaaagctca

SEQ ID NO: 29557 - DNA, 813 bp, Homo sapiens
ggggcaggaacgacaaactcaaagtccagagtccagcctgttattgtgaatggagccgagatttgccctctaccctcacctaagctctgatccttcagtgcccgcaataggcggctcatctgttatccattgtgtaaatgactagaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgca

SEQ ID NO: 29558 - DNA, 580 bp, Homo sapiens
gaaattgcctaactagctgacgtgggtgcaccaactctacagtcctccctccacccaatctccatgacgtctctcagtcaagggaggaggagcagagccagccccacgaggccacggaagacagggtcacttgttcctgccaaggaaagagggtggaaaagtcattcaactcaagcagatcaaagttgttttgagatctaaaggaagaagttcttgctgccaggatcctcagatgcccatgaaggggctttccaggtgatggggaggggcttcaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaa

SEQ ID NO: 29559 - DNA, 2032 bp, Homo sapiens
gaaattgcctaactagctgacgtgggtgcaccaactctacagtcctccctccacccaatctccatgacgtctctcagtcaagggaggaggagcagagccagccccacgaggccacggaagacagggtcacttgttcctgccaaggaaagagggtggaaaagtcattcaactcaagcagatcaaagttgttttgagatctaaaggaagaagttcttgctgccaggatcctcagatgcccatgaaggggctttccaggtgatggggaggggcttcaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaggagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagattgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagagtggacttttgctctgtcctccaagaataaatctcaagagagagttaaatagcaagtgaatttctactaccctctcagtcaccatgttgcagactttccctgtctggaggctcaccttagagcttctgagtttccaagctctgagtcacctccacatttgggcat

SEQ ID NO: 29560 - DNA, 6359 bp, Homo sapiens
gggacgaatttcctccccagctcagctcccctacagcttggctaggcctgctccgagcgcctgcaaggtggaggaggcctgcgcctcgggcctggcagcggcagccggcgagggaggcgggcacagcggggtaaccggcgagccgtagccgctctcgaaaacctacgctgccacggccgctcattgtctctccccttccacccgggggcaaacaggaagcgcgccgcctggcagaccgacggacaggcgcctggaccaatgagcacagccgacaaagagcacggcggcgaatgagagccaagaagaggggcgggagttccgggcgggctgtcaccctcttccccccttttgggctggaggctccaccttttgtgtttcccgcacagtcaatcaaaataggaaaaaaaaatccccggaccgctccggccgtgtccgccgccgcttcccgcatcctctcccgccgccgccgccttcgctcctcaccatgtgtaaggcggcggggagccccgcctgaggtgccctaaacacactatgaccgctcccgaaaagcccgtgaaacaagaggaaatggctgccttggacgtggatagcggcggcggcggtggcggcggcggcggccacggcgagtatctgcagcagcagcaacagcacggaaacggtgcggtggcggcggcagcggcggcccaggacactcagccgtcaccgctcgctctgctggccgctacctgcagcaagatagggccgccatcgccgggcgacgacgaggaggaggcggccgccgcagccggggcccccgccgccgccggagcgacaggtgatttggcttctgcacagttaggaggagcaccaaaccgatgggaggttttgtcagccacacctacaactataaaagatgaagctggtaatctagtccagattccaagtgctgctacttcaagtgggcagtatgttcttccccttcagaatttgcagaatcaacaaatattttccgttgcaccaggatcagattcatcaaatggtacagtgtccagtgttcaatatcaagtgataccacagatccagtcagcagatggtcagcaggttcaaattggtttcacaggctcttcagataatgggggtataaatcaagaaagcagtcaaattcagatcattcctggctctaatcaaaccttacttgcctctggaacaccttctgctaacatccagaatctcataccacagactggtcaagtccaggttcagggagttgcaattggtggttcatcttttcctggtcaaacccaagtagttgctaatgtgcctcttggtctgccaggaaatattacgtttgtaccaatcaatagtgtcgatctagattctttgggactctcgggcagttctcagacaatgactgcaggcattaatgccgacggacatttgataaacacaggacaagctatggatagttcagacaattcagaaaggactggtgagcgggtttctcctgatattaatgaaactaatactgatacagatttatttgtgccaacatcctcttcatcacagttgcctgttacgatagatagtacaggtatattacaacaaaacacaaatagcttgactacatctagtgggcaggttcattcttcagatcttcagggaaattatatccagtcgcctgtttctgaagagacacaggcacagaatattcaggtttctacagcacagcctgttgtacagcatctacaacttcaagagtctcagcagccaaccagtcaagcccaaattgtgcaaggtattacaccacagacaatccatggtgtgcaagccagtggtcaaaatatatcacaacaggctttgcaaaatcttcagttgcagctgaatcctggaacctttttaattcaggcacagacagtgaccccttctggacaggtaacttggcaaacgtttcaagtacaaggggtccagaacttgcagaatttgcaaatacagaatactgctgcccaacaaataactttgacgcctgttcaaaccctcacacttggtcaagttgcggcaggtggagccttcacttcaactccagttagtctaagcactggtcagttgccaaatctacaaacagttacagtgaactctatagattctgctggtatacagctacatccaggagagaatgctgacagtcctgcagatattaggatcaaggaagaagaacctgatcctgaagagtggcagctcagtggtgattctaccttgaataccaatgacctaacacacttaagagtacaggtggtagatgaagaaggggaccaacaacatcaagaaggaaaaagacttcggagggtagcttgcacctgtcccaactgtaaagaaggtggtggaagaggtaccaatcttgggaaaaagaagcaacacatttgtcatataccaggatgtggtaaagtctatgggaagacctcacatctgagagctcatctgcgttggcattctggagaacgcccttttgtttgtaactggatgtactgtggtaaaagatttactcgaagtgatgaattacagaggcacagaagaacacatacaggtgagaagaaatttgtttgtccagaatgttcaaaacgctttatgagaagtgaccaccttgccaaacatattaaaacacaccagaataaaaaaggtattcactctagcagtacagtgctggcatctgtggaagctgcgcgagatgatactttgattactgcaggaggaacaacgcttatccttgcaaatattcaacaaggttctgtttcagggataggaactgttaatacttccgccaccagcaatcaagatatccttaccaacactgaaatacctttacagcttgtcacagtttctggaaatgagacaatggagtaaatattacacaaatacttattcattgtggttatttttatacagtagtgagaagaatattgttcctaagttcttagatatctttttattgatgtgcaaaaatttttggattgacagtaacttggttatacatgacactgaaatgccttactttgtatgatattccatagtatattaaaaatggtaaaattgcatgggttttgtaggtacttttggaatctagaagaaatgaaattttaccaagttatataaagagaaaattgaatttaacaatgcgaatggtagtctaaccaaatgcatcaatcctgtgtggtttagtgtaaaaatgagaacatgttggtatttatctattgtaagataaaaaagctggtgggtgaaagaaatcatgttatgataaaaaattttgtaattttcttgatgactggaatttttattatgcataactgacaaatcaagtttccaagcaaatgttacatagtgtaggctttacttagcttatcaatttgtcattttgaagctaattattttaattaggttaactatgtacaatattttaagcattactcttgtaagattttgaaaactacattttaacatggaactctagggatagtcaccttttaaatcctgttgaaaagccatgtttaagatttaatttgccaaaataatgtcttgttaatattctttcaataacgaagttgggcaatataaccaatgtttaaaaaagtttaaaatgtataagttgaggcatttgggtggtaagagaatgttatagtgaattatcccttttcttgactattggaggaccaaaaaaataaggtgtattgcgtcttagcagtgatttttatccaatcttgtttccaaaaaccatgtctcccagggccttaaaagccatcatgtaaattaccagtaaagtgtaacatatgcaaacataacaaaatcacttccatagtgacgatactccaaccatatggatattagtcatagaagaactagaggttttatgatatttttttaagtcttttttttttttgtctaggtagtcagtctgcacttaaatatcaatcattttccttttttgcttcttcccttaaaatttatatgtatccagtacatttaattgagaagcgtatgttttttattatgctgtattttctttttattttttaattattgtttatattttcaattcaaaaatgtacaaaataaagttacattgctggtcttgtaagagctatacagttttcctaaatgtatacctgtaactgcagcagttcacctatttcaaaaatttggaattctgttcatttgttattcttaagaccacctcaaatttaaaggctaccttattgtacgtttaaagtgtattataacagtgtggtagttaataaaacactatttttttttcttttgagtttgttgtattcctatgcataaaaaatattgcagtggtatggggtaagaattggtggtttatttttcttcaacttggctttttatttttagattcttgattttagacactgaattgtaaacaggcatttatttgaagaagagatatatagagacactggtcatttactaattttttacctagagtaaataagaatgagcttattaaataaaatttttgaaaaaaagtcttagcccttagcccacattgattcatatcagttttatcagtaccattttgcaatttttttgttttccgttttaaagcaatgcagaatattttgatttatcgaaaacctgaatttacattaagactcctgaaaatgataagacaagcgttggtaaccatggcaggagttacttgaaaaagttgcctttgaatttgcatgtgtttcatcattataaaggcagagtaggaggaaagagtattaatgtgattgtgtattgtagatgttttaaagtaaaaatcaagtttcttaacacatgtatacagtgggggtaaagatgtccattttctgttttccaggcccagtctgactctgtctgtaatacctgattgcattggagaactctagacacgcataaacatggacagtttttctaaatgtgagacttaagcctgtgatgtaaaataggaagttctacttggaataatataaaggaaccactagaatttacaattattttgaagttacagggattagattttgaatcttaaaatcctttaggtaatttttagaatttttaaattaagattaatgtgaagagaattaagtgagcagcaggtggttcacttgagcaaactgcccattaagtcagattaaaccatttgaatgatagtagagatgttttaagtaatactggatttttacagtaagtttatggtgtactttgaatcgataggtgtccatgcatattttatgaattcgtggagaatgaatgcaatgaagaaagtaagtagtcttgaaaattatttaaataaagttgtagatttttttagtgccccctaggaatatattagtgaactttggaacttttaccaaagttatgtaacctcagtgtagataattttaaatatttctatttttatattttaaaatgttgaatatactctggaaacaacatttgaagatttgctctgatgtcaactttttctggttataaaacctattagtattgtgtataattctcagggtaggtatactctaataggtgttttgtcaattgctttatttttgtaaaggctagagttagtgcatattgaatatatttatgtacaaataattcctgttgtaacatttagtggacgcgattatctgtatacctcaaattttaatttaagaaagtatcacttaaagagcatctcattttctatagattgaggcttaattactgaaaagtgactcaaccaaaaagcacataaccttttaaaggagctacacctaccgcagaaagtcagatgccctgtaaataactttggtctttcaaaatagtggcaatgcttaagatacttaaaaatacacatacatataagctgaaagcatgtcaagcctatttcatagaaaatagttcttaaacagtattgttcattagaaattgctggggagcattttagagattccataggcctggtagccacctcagcttactaaatcaacatctctggagatggagtgtatatgtgttttgaaacagctgctcaagtggttctgttaaacactcctgcgttacaatcacttaaaatagagcaagcatccccttaggctcttaattgtagtttaaattccagtactgcctactcagacccaaaagttttgttttatgaaaaatttgtattgtgttcaatattgtttgaaatttggggttgttgcataaatgattatggaataacatttggttttaaaataatataaactgacatgttatgctacctgttacacaatttggttttcagttttaattatatgaagctggtaacaatcgtttttgttgtaaaagaattatttttcactaaacagtatgtttaaaactga

SEQ ID NO: 29561 - DNA, 3627 bp, Homo sapiens
ctcccgaaaagcccgtgaaacaagaggaaatggctgccttggacgtggatagcggcggcggcggtggcggcggcggcggccacggcgagtatctgcagcagcagcaacagcacggaaacggtgcggtggcggcggcagcggcggcccagacaggtgatttggcttctgcacagttaggaggagcaccaaaccgatgggaggttttgtcagccacacctacaactataaaagatgaagctggtaatctagtccagattccaagtgctgctacttcaagtgggcagtatgttcttccccttcagaatttgcagaatcaacaaatattttccgttgcaccaggatcagattcatcaaatggtacagtgtccagtgttcaatatcaagtgataccacagatccagtcagcagatggtcagcaggttcaaattggtttcacaggctcttcagataatgggggtataaatcaagaaagcagtcaaattcagatcattcctggctctaatcaaaccttacttgcctctggaacaccttctgctaacatccagaatctcataccacagactggtcaagtccaggttcagggagttgcaattggtggttcatcttttcctggtcaaacccaagtagttgctaatgtgcctcttggtctgccaggaaatattacgtttgtaccaatcaatagtgtcgatctagattctttgggactctcgggcagttctcagacaatgactgcaggcattaatgccgacggacatttgataaacacaggacaagctatggatagttcagacaattcagaaaggactggtgagcgggtttctcctgatattaatgaaactaatactgatacagatttatttgtgccaacatcctcttcatcacagttgcctgttacgatagatagtacaggtatattacaacaaaacacaaatagcttgactacatctagtgggcaggttcattcttcagatcttcagggaaattatatccagtcgcctgtttctgaagagacacaggcacagaatattcaggtttctacagcacagcctgttgtacagcatctacaacttcaagagtctcagcagccaaccagtcaagcccaaattgtgcaaggtattacaccacagacaatccatggtgtgcaagccagtggtcaaaatatatcacaacaggctttgcaaaatcttcagttgcagctgaatcctggaacctttttaattcaggcacagacagtgaccccttctggacaggtaacttggcaaacgtttcaagtacaaggggtccagaacttgcagaatttgcaaatacagaatactgctgcccaacaaataactttgacgcctgttcaaaccctcacacttggtcaagttgcggcaggtggagccttcacttcaactccagttagtctaagcactggtcagttgccaaatctacaaacagttacagtgaactctatagattctgctggtatacagctacatccaggagagaatgctgacagtcctgcagatattaggatcaaggaagaagaacctgatcctgaagagtggcagctcagtggtgattctaccttgaataccaatgacctaacacacttaagagtacaggtggtagatgaagaaggggaccaacaacatcaagaaggaaaaagacttcggagggtagcttgcacctgtcccaactgtaaagaaggtggtggaagaggtaccaatcttgggaaaaagaagcaacacatttgtcatataccaggatgtggtaaagtctatgggaagacctcacatctgagagctcatctgcgttggcattctggagaacgcccttttgtttgtaactggatgtactgtggtaaaagatttactcgaagtgatgaattacagaggcacagaagaacacatacaggtgagaagaaatttgtttgtccagaatgttcaaaacgctttatgagaagtgaccaccttgccaaacatattaaaacacaccagaataaaaaaggtattcactctagcagtacagtgctggcatctgtggaagctgcgcgagatgatactttgattactgcaggaggaacaacgcttatccttgcaaatattcaacaaggttctgtttcagggataggaactgttaatacttccgccaccagcaatcaagatatccttaccaacactgaaatacctttacagcttgtcacagtttctggaaatgagacaatggagtaaatattacacaaatacttattcattgtggttatttttatacagtagtgagaagaatattgttcctaagttcttagatatctttttattgatgtgcaaaaatttttggattgacagtaacttggttatacatgacactgaaatgccttactttgtatgatattccatagtatattaaaaatggtaaaattgcatgggttttgtaggtacttttggaatctagaagaaatgaaattttaccaagttatataaagagaaaattgaatttaacaatgcgaatggtagtctaaccaaatgcatcaatcctgtgtggtttagtgtaaaaatgagaacatgttggtatttatctattgtaagataaaaaagctggtgggtgaaagaaatcatgttatgataaaaaattttgtaattttcttgatgactggaatttttattatgcataactgacaaatcaagtttccaagcaaatgttacatagtgtaggctttacttagcttatcaatttgtcattttgaagctaattattttaattaggttaactatgtacaatattttaagcattactcttgtaagattttgaaaactacattttaacatggaactctagggatagtcaccttttaaatcctgttgaaaagccatgtttaagatttaatttgccaaaataatgtcttgttaatattctttcaataacgaagttgggcaatataaccaatgtttaaaaaagtttaaaatgtataagttgaggcatttgggtggtaagagaatgttatagtgaattatcccttttcttgactattggaggaccaaaaaaataaggtgtattgcgtcttagcagtgatttttatccaatcttgtttccaaaaaccatgtctcccagggccttaaaagccatcatgtaaattaccagtaaagtgtaacatatgcaaacataacaaaatcacttccatagtgacgatactccaaccatatggatattagtcatagaagaactagaggttttatgatatttttttaagtcttttttttttttgtctaggtagtcagtctgcacttaaatatcaatcattttccttttttgcttcttcccttaaaatttatatgtatccagtacatttaattgagaagcgtatgttttttattatgctgtattttctttttattttttaattattgtttatattttcaattcaaaaatgtacaaaataaagttacattgctggtcttgtaagagctatacagttttcctaaatgtatacctgtaactgcagcagttcacctatttcaaaaatttggaattctgttcatttgttattcttaagaccacctcaaatttaaaggctaccttattgtacgtttaaagtgtattataacagtgtggtagttaataaaacactatttttttttcttttga

SEQ ID NO: 29562 - DNA, 3937 bp, Homo sapiens
cctcgcccgcctgccgcctttttgtgcgcgtgtgagtgtgggccccagcgtgccctcccgggggtgggttccgggcggaaggcggaggcccggcgcgcagcccgccgcccgcctgcccgcggaccggggagccggggtgcttggagcgggggacgccaggcgtgggctggcggcgggaccaggaggaggaggaggaggaggaggagagcgcgggctggcgcttgcccgggcgcagtcggcggggaccgagtcgtacttcctgtgcgaaaggcggcccgaccctaaccgccaccccctccccctgtctccctctctgaacccgcccattgggggtaggacactcagccgtcaccgctcgctctgctggccgctacctgcagcaagatagggccgccatcgccgggcgacgacgaggaggaggcggccgccgcagccggggcccccgccgccgccggagcgacaggtgatttggcttctgcacagttaggaggagcaccaaaccgatgggaggttttgtcagccacacctacaactataaaagatgaagctggtaatctagtccagattccaagtgctgctacttcaagtgggcagtatgttcttccccttcagaatttgcagaatcaacaaatattttccgttgcaccaggatcagattcatcaaatggtacagtgtccagtgttcaatatcaagtgataccacagatccagtcagcagatggtcagcaggttcaaattggtttcacaggctcttcagataatgggggtataaatcaagaaagcagtcaaattcagatcattcctggctctaatcaaaccttacttgcctctggaacaccttctgctaacatccagaatctcataccacagactggtcaagtccaggttcagggagttgcaattggtggttcatcttttcctggtcaaacccaagtagttgctaatgtgcctcttggtctgccaggaaatattacgtttgtaccaatcaatagtgtcgatctagattctttgggactctcgggcagttctcagacaatgactgcaggcattaatgccgacggacatttgataaacacaggacaagctatggatagttcagacaattcagaaaggactggtgagcgggtttctcctgatattaatgaaactaatactgatacagatttatttgtgccaacatcctcttcatcacagttgcctgttacgatagatagtacaggtatattacaacaaaacacaaatagcttgactacatctagtgggcaggttcattcttcagatcttcagggaaattatatccagtcgcctgtttctgaagagacacaggcacagaatattcaggtttctacagcacagcctgttgtacagcatctacaacttcaagagtctcagcagccaaccagtcaagcccaaattgtgcaaggtattacaccacagacaatccatggtgtgcaagccagtggtcaaaatatatcacaacaggctttgcaaaatcttcagttgcagctgaatcctggaacctttttaattcaggcacagacagtgaccccttctggacaggtaacttggcaaacgtttcaagtacaaggggtccagaacttgcagaatttgcaaatacagaatactgctgcccaacaaataactttgacgcctgttcaaaccctcacacttggtcaagttgcggcaggtggagccttcacttcaactccagttagtctaagcactggtcagttgccaaatctacaaacagttacagtgaactctatagattctgctggtatacagctacatccaggagagaatgctgacagtcctgcagatattaggatcaaggaagaagaacctgatcctgaagagtggcagctcagtggtgattctaccttgaataccaatgacctaacacacttaagagtacaggtggtagatgaagaaggggaccaacaacatcaagaaggaaaaagacttcggagggtagcttgcacctgtcccaactgtaaagaaggtggtggaagaggtaccaatcttgggaaaaagaagcaacacatttgtcatataccaggatgtggtaaagtctatgggaagacctcacatctgagagctcatctgcgttggcattctggagaacgcccttttgtttgtaactggatgtactgtggtaaaagatttactcgaagtgatgaattacagaggcacagaagaacacatacaggtgagaagaaatttgtttgtccagaatgttcaaaacgctttatgagaagtgaccaccttgccaaacatattaaaacacaccagaataaaaaaggtattcactctagcagtacagtgctggcatctgtggaagctgcgcgagatgatactttgattactgcaggaggaacaacgcttatccttgcaaatattcaacaaggttctgtttcagggataggaactgttaatacttccgccaccagcaatcaagatatccttaccaacactgaaatacctttacagcttgtcacagtttctggaaatgagacaatggagtaaatattacacaaatacttattcattgtggttatttttatacagtagtgagaagaatattgttcctaagttcttagatatctttttattgatgtgcaaaaatttttggattgacagtaacttggttatacatgacactgaaatgccttactttgtatgatattccatagtatattaaaaatggtaaaattgcatgggttttgtaggtacttttggaatctagaagaaatgaaattttaccaagttatataaagagaaaattgaatttaacaatgcgaatggtagtctaaccaaatgcatcaatcctgtgtggtttagtgtaaaaatgagaacatgttggtatttatctattgtaagataaaaaagctggtgggtgaaagaaatcatgttatgataaaaaattttgtaattttcttgatgactggaatttttattatgcataactgacaaatcaagtttccaagcaaatgttacatagtgtaggctttacttagcttatcaatttgtcattttgaagctaattattttaattaggttaactatgtacaatattttaagcattactcttgtaagattttgaaaactacattttaacatggaactctagggatagtcaccttttaaatcctgttgaaaagccatgtttaagatttaatttgccaaaataatgtcttgttaatattctttcaataacgaagttgggcaatataaccaatgtttaaaaaagtttaaaatgtataagttgaggcatttgggtggtaagagaatgttatagtgaattatcccttttcttgactattggaggaccaaaaaaataaggtgtattgcgtcttagcagtgatttttatccaatcttgtttccaaaaaccatgtctcccagggccttaaaagccatcatgtaaattaccagtaaagtgtaacatatgcaaacataacaaaatcacttccatagtgacgatactccaaccatatggatattagtcatagaagaactagaggttttatgatatttttttaagtcttttttttttttgtctaggtagtcagtctgcacttaaatatcaatcattttccttttttgcttcttcccttaaaatttatatgtatccagtacatttaattgagaagcgtatgttttttattatgctgtattttctttttattttttaattattgtttatattttcaattcaaaaatgtacaaaataaagttacattgctggtcttgtaagagctatacagttttcctaaatgtatacctgtaactgcagcagttcacctatttcaaaaatttggaattctgttcatttgttattcttaagaccacctcaaatttaaaggctaccttattgtacgtttaaagtgtattataacagtgtggtagttaataaaacactatttttttttcttttga

SEQ ID NO: 29563 - DNA, 6236 bp, Homo sapiens
gggacgaatttcctccccagctcagctcccctacagcttggctaggcctgctccgagcgcctgcaaggtggaggaggcctgcgcctcgggcctggcagcggcagccggcgagggaggcgggcacagcggggtaaccggcgagccgtagccgctctcgaaaacctacgctgccacggccgctcattgtctctccccttccacccgggggcaaacaggaagcgcgccgcctggcagaccgacggacaggcgcctggaccaatgagcacagccgacaaagagcacggcggcgaatgagagccaagaagaggggcgggagttccgggcgggctgtcaccctcttccccccttttgggctggaggctccaccttttgtgtttcccgcacagtcaatcaaaataggaaaaaaaaatccccggaccgctccggccgtgtccgccgccgcttcccgcatcctctcccgccgccgccgccttcgctcctcaccatgtgtaaggcggcggggagccccgcctgaggtgccctaaacacactatgaccgctcccgaaaagcccgtgaaacaagaggaaatggctgccttggacgtggatagcggcggcggcggtggcggcggcggcggccacggcgagtatctgcagcagcagcaacagcacggaaacggtgcggtggcggcggcagcggcggcccagacaggtgatttggcttctgcacagttaggaggagcaccaaaccgatgggaggttttgtcagccacacctacaactataaaagatgaagctggtaatctagtccagattccaagtgctgctacttcaagtgggcagtatgttcttccccttcagaatttgcagaatcaacaaatattttccgttgcaccaggatcagattcatcaaatggtacagtgtccagtgttcaatatcaagtgataccacagatccagtcagcagatggtcagcaggttcaaattggtttcacaggctcttcagataatgggggtataaatcaagaaagcagtcaaattcagatcattcctggctctaatcaaaccttacttgcctctggaacaccttctgctaacatccagaatctcataccacagactggtcaagtccaggttcagggagttgcaattggtggttcatcttttcctggtcaaacccaagtagttgctaatgtgcctcttggtctgccaggaaatattacgtttgtaccaatcaatagtgtcgatctagattctttgggactctcgggcagttctcagacaatgactgcaggcattaatgccgacggacatttgataaacacaggacaagctatggatagttcagacaattcagaaaggactggtgagcgggtttctcctgatattaatgaaactaatactgatacagatttatttgtgccaacatcctcttcatcacagttgcctgttacgatagatagtacaggtatattacaacaaaacacaaatagcttgactacatctagtgggcaggttcattcttcagatcttcagggaaattatatccagtcgcctgtttctgaagagacacaggcacagaatattcaggtttctacagcacagcctgttgtacagcatctacaacttcaagagtctcagcagccaaccagtcaagcccaaattgtgcaaggtattacaccacagacaatccatggtgtgcaagccagtggtcaaaatatatcacaacaggctttgcaaaatcttcagttgcagctgaatcctggaacctttttaattcaggcacagacagtgaccccttctggacaggtaacttggcaaacgtttcaagtacaaggggtccagaacttgcagaatttgcaaatacagaatactgctgcccaacaaataactttgacgcctgttcaaaccctcacacttggtcaagttgcggcaggtggagccttcacttcaactccagttagtctaagcactggtcagttgccaaatctacaaacagttacagtgaactctatagattctgctggtatacagctacatccaggagagaatgctgacagtcctgcagatattaggatcaaggaagaagaacctgatcctgaagagtggcagctcagtggtgattctaccttgaataccaatgacctaacacacttaagagtacaggtggtagatgaagaaggggaccaacaacatcaagaaggaaaaagacttcggagggtagcttgcacctgtcccaactgtaaagaaggtggtggaagaggtaccaatcttgggaaaaagaagcaacacatttgtcatataccaggatgtggtaaagtctatgggaagacctcacatctgagagctcatctgcgttggcattctggagaacgcccttttgtttgtaactggatgtactgtggtaaaagatttactcgaagtgatgaattacagaggcacagaagaacacatacaggtgagaagaaatttgtttgtccagaatgttcaaaacgctttatgagaagtgaccaccttgccaaacatattaaaacacaccagaataaaaaaggtattcactctagcagtacagtgctggcatctgtggaagctgcgcgagatgatactttgattactgcaggaggaacaacgcttatccttgcaaatattcaacaaggttctgtttcagggataggaactgttaatacttccgccaccagcaatcaagatatccttaccaacactgaaatacctttacagcttgtcacagtttctggaaatgagacaatggagtaaatattacacaaatacttattcattgtggttatttttatacagtagtgagaagaatattgttcctaagttcttagatatctttttattgatgtgcaaaaatttttggattgacagtaacttggttatacatgacactgaaatgccttactttgtatgatattccatagtatattaaaaatggtaaaattgcatgggttttgtaggtacttttggaatctagaagaaatgaaattttaccaagttatataaagagaaaattgaatttaacaatgcgaatggtagtctaaccaaatgcatcaatcctgtgtggtttagtgtaaaaatgagaacatgttggtatttatctattgtaagataaaaaagctggtgggtgaaagaaatcatgttatgataaaaaattttgtaattttcttgatgactggaatttttattatgcataactgacaaatcaagtttccaagcaaatgttacatagtgtaggctttacttagcttatcaatttgtcattttgaagctaattattttaattaggttaactatgtacaatattttaagcattactcttgtaagattttgaaaactacattttaacatggaactctagggatagtcaccttttaaatcctgttgaaaagccatgtttaagatttaatttgccaaaataatgtcttgttaatattctttcaataacgaagttgggcaatataaccaatgtttaaaaaagtttaaaatgtataagttgaggcatttgggtggtaagagaatgttatagtgaattatcccttttcttgactattggaggaccaaaaaaataaggtgtattgcgtcttagcagtgatttttatccaatcttgtttccaaaaaccatgtctcccagggccttaaaagccatcatgtaaattaccagtaaagtgtaacatatgcaaacataacaaaatcacttccatagtgacgatactccaaccatatggatattagtcatagaagaactagaggttttatgatatttttttaagtcttttttttttttgtctaggtagtcagtctgcacttaaatatcaatcattttccttttttgcttcttcccttaaaatttatatgtatccagtacatttaattgagaagcgtatgttttttattatgctgtattttctttttattttttaattattgtttatattttcaattcaaaaatgtacaaaataaagttacattgctggtcttgtaagagctatacagttttcctaaatgtatacctgtaactgcagcagttcacctatttcaaaaatttggaattctgttcatttgttattcttaagaccacctcaaatttaaaggctaccttattgtacgtttaaagtgtattataacagtgtggtagttaataaaacactatttttttttcttttgagtttgttgtattcctatgcataaaaaatattgcagtggtatggggtaagaattggtggtttatttttcttcaacttggctttttatttttagattcttgattttagacactgaattgtaaacaggcatttatttgaagaagagatatatagagacactggtcatttactaattttttacctagagtaaataagaatgagcttattaaataaaatttttgaaaaaaagtcttagcccttagcccacattgattcatatcagttttatcagtaccattttgcaatttttttgttttccgttttaaagcaatgcagaatattttgatttatcgaaaacctgaatttacattaagactcctgaaaatgataagacaagcgttggtaaccatggcaggagttacttgaaaaagttgcctttgaatttgcatgtgtttcatcattataaaggcagagtaggaggaaagagtattaatgtgattgtgtattgtagatgttttaaagtaaaaatcaagtttcttaacacatgtatacagtgggggtaaagatgtccattttctgttttccaggcccagtctgactctgtctgtaatacctgattgcattggagaactctagacacgcataaacatggacagtttttctaaatgtgagacttaagcctgtgatgtaaaataggaagttctacttggaataatataaaggaaccactagaatttacaattattttgaagttacagggattagattttgaatcttaaaatcctttaggtaatttttagaatttttaaattaagattaatgtgaagagaattaagtgagcagcaggtggttcacttgagcaaactgcccattaagtcagattaaaccatttgaatgatagtagagatgttttaagtaatactggatttttacagtaagtttatggtgtactttgaatcgataggtgtccatgcatattttatgaattcgtggagaatgaatgcaatgaagaaagtaagtagtcttgaaaattatttaaataaagttgtagatttttttagtgccccctaggaatatattagtgaactttggaacttttaccaaagttatgtaacctcagtgtagataattttaaatatttctatttttatattttaaaatgttgaatatactctggaaacaacatttgaagatttgctctgatgtcaactttttctggttataaaacctattagtattgtgtataattctcagggtaggtatactctaataggtgttttgtcaattgctttatttttgtaaaggctagagttagtgcatattgaatatatttatgtacaaataattcctgttgtaacatttagtggacgcgattatctgtatacctcaaattttaatttaagaaagtatcacttaaagagcatctcattttctatagattgaggcttaattactgaaaagtgactcaaccaaaaagcacataaccttttaaaggagctacacctaccgcagaaagtcagatgccctgtaaataactttggtctttcaaaatagtggcaatgcttaagatacttaaaaatacacatacatataagctgaaagcatgtcaagcctatttcatagaaaatagttcttaaacagtattgttcattagaaattgctggggagcattttagagattccataggcctggtagccacctcagcttactaaatcaacatctctggagatggagtgtatatgtgttttgaaacagctgctcaagtggttctgttaaacactcctgcgttacaatcacttaaaatagagcaagcatccccttaggctcttaattgtagtttaaattccagtactgcctactcagacccaaaagttttgttttatgaaaaatttgtattgtgttcaatattgtttgaaatttggggttgttgcataaatgattatggaataacatttggttttaaaataatataaactgacatgttatgctacctgttacacaatttggttttcagttttaattatatgaagctggtaacaatcgtttttgttgtaaaagaattatttttcactaaacagtatgtttaaaactga

SEQ ID NO: 29564 - DNA, 6126 bp, Homo sapiens
atcaagggcgagtcagccgggctcgggcggagagaggagctgctacgccacagcccagcggcggccattcgcggaaaaagaggcagagcctgtgccagctacagcctcctccgagccaccgcgggcgggcgggaccggcctctcctcccgcctcgcccccacccccacccacctctatcccagtgtctccgtctgagggtttgtcctgttaatgcgggatgagcgatcagaagaaggaggaggaggaggaggcggcagcggcagcggcgatggctacagaaggagggaaaacctctgagccagagaataacaataaaaaacccaaaacctcaggctcccaggactctcagccctctcctctggctttactggcagctacttgcagcaaaatagggactcctggtgaaaatcaagcaactggacaacaacaaattattatagatccaagtcaaggattggtgcaacttcaaaatcaaccacaacagctagaactggtaacaacgcaacttgctggaaacgcttggcaacttgttgcctccactcctcctgcttcaaaagagaataacgtttctcaaccagcctctagttcgtctagttcttccagcagtaataacgggagtgcatctcctacaaaaactaaatcaggtaattcttccacccctggtcaatttcaagtcatacaagtacaaaatccaagtggtagtgtacagtaccaagtaattccacaacttcagacagtggaaggtcaacaaattcaaatcaatccaactagtagttcatctctacaggatttgcagggtcaaattcagctcatttctgcaggtaataatcaagctatactcacagctgctaacaggacagcttctgggaatattcttgctcaaaacctggcaaatcagacagttccggtccaaattagacctggtgtttcaataccactgcagttacagactcttcctggtactcaggctcaagttgtaacaaccctaccaattaacattggaggagtgactctagctttgccagtgataaacaacgtggctgccggaggagggactgggcaggttggccagcctgctgctactgctgatagtgggacttccaatgggaatcaattagtttccacacccaccaacaccactacttctgccagtactatgccagaatctccctcctcctccactacctgcacaaccactgcttcaacgtctttgacaagcagtgacacattagtgagctcagcagatactggccagtatgcaagcacatcagccagtagttctgaacgcaccattgaagaatctcaaacacctgctgctactgagtctgaagcccagagctccagtcagcttcagcctaatggaatgcagaatgcacaggatcaatcaaattctcttcagcaggtgcaaattgtaggccaacctatcttacagcagatccagatccaacagcctcagcaacagatcattcaggctattccaccacagtcgtttcaactccagtcagggcagacgattcagaccatccagcagcagcctttacagaatgttcaacttcaagcagtaaatccgactcaggtgcttatcagggctccaactttaacaccttcagggcaaatcagttggcaaactgtacaggttcagaatattcagagtctttcaaatttgcaagttcagaatgctgggttatcccaacaattaaccatcaccccagtgtcttcaagtggtggcacaactcttgctcagattgctcctgtggctgttgctggtgccccaataactttgaatactgcccagcttgcatcagtgcctaaccttcagacagtgagcgttgccaacctgggtgctgcaggtgttcaagtgcagggagttcccgttacaatcactagtgttgcaggtcagcagcaaggacaagatggagtaaaagtccagcaagctactatagctcctgtaactgtagcagttggaggaattgctaatgccacgataggtgctgttagtcctgaccaactcacacaagtgcatttgcagcaaggccagcagacttctgatcaagaggtacaacctggcaagaggcttcgaagagttgcctgttcctgtcctaattgtagggaaggagaaggaagaggcagtaatgaaccaggaaaaaagaagcagcatatctgtcatattgaaggatgtggtaaagtttatggcaaaacatctcatttacgagcacatcttcgctggcatactggagaaagaccttttatatgcaactggatgttttgtggcaaaagattcacacggagtgatgagctccagagacatagaagaacccatacaggtgaaaagagatttgaatgcccggaatgttctaaaaggtttatgcggagtgatcatctctccaaacatgtcaaaacgcaccagaataaaaaaggtggtgggacagctcttgccattgttacctcgggagaactggactcatctgttacagaggtgcttggctccccaagaattgtcacagttgcagccatttctcaagattcgaatccagcaactcccaatgtttcaaccaacatggaagaattctgaaaagttatttataacagagacctctagtgctgcacttgtttacacacctttgaaaatctggaaatgggctggtcaagtggattacagagtaggaaattatgttttcattcttggcttctttaagtattccagggtttggggtcaacacgtgaagtgttgaattttaaaaaatacaaaaagcagactgatgtactggaaacagaaaagtatttcctccatactataagttgtagttgtttggaaatatatcacataacctttatacagaatcttcccatctcttaatatcatgtgttaacatgtttaaaaagaccttagtagtttgcaggctggaccttaattggacttattttctttgaaagtactttgttataaattcagtcagtaataatttacgtgtattctttttctctatagcacagaaaacagatagttaactgatgatagggataatactgtatttccttagcttgatttttggaaaatcaaccgaaaatagtttggccgtcttttctaaatgttagaaattcttcaacagttgaattaggtaagttccaaaacagtaatctgagatgcatctcagatctttattaccactacattatagtagtgtgtatgcagacaatcagtgaagtccaattactttctccatttggagacacaagaggaacatagagttaaatcttaggttaaattttaggttgacaccttaggaaaatgctgggaaaaaaatggttaaaacaaaactcatcatagcttcagaaaaataaaatgaggcatcttaacatgcaatgttctaaagttaggattgattatattcctaaccctaggttgaaccacaaaatttcatttaaaatgtttatatttggaaatatttgcatagagtgtaaattgttctgtagtttcatattttgtaaatatgagttatgttgacaatgtgcagaattctttatgctttgatgtggtagccaaagaaagaattacacttttttccaaggccagcagaaaattctcttttaactacattgtaattcttgttttcctctactaaaaattggccagtcccattttatttctagtgctatgtaagaaggtaattaggaattataacacagtaatgtttttatgttacatcaataactgaattttccctaaaaattagcctaatatataatagatatattatgaagcaaaacttttatttttgaaaaggcagaataattttcagtgaagtaagtgactaaagaaaaaaactatattattgtttatgcaagggtcttacaggaaagggtctttttttttttttttttgagatggagtctcgctctcttgcccaggctggagtgcaatggcacgatctcagcttactgcaaccgccgcctcccaggttcaagcgattctcctgtcttagcctcctgagtagctgggattaacaggcgcctgccaccatgcctggctaatttttgtatttttagtagagacagggtttcgccatgttggccaggctggtttcaaactcctgacctcaggtgatctgcccacctcggcctcccagagtgctgggattacaggcatgagccaccatgcccggctaggaaagggtcttactaggaaagatggccaaaagtttcatatgaaaaaaattggattataaaccagtaacttaaatattaataaggatattttatgttttaaaaaagtatttacacagaatcataatcagtgaaattgaccatttgaaaactaaaagtttttacctacctgctcaatttattaacatcattgctttggggactgtttgaatataggtacgtgttttcttgtgcattctctataatttcaggaaaagtactaatgcgaattctcttccaaaattgtgatgtttcttgtatttttgatgaaggagaaatactgtaatgatcactgtttacactatgtacactttaggccagccctttgtagcgttatataaaactgaaggtcttttgtgctttcagtttgtataaaaaagctttgagattaaaggaaaaaaaaaatttttacactgtggttataaatttcaagtttcttaaagcttttgtagacttgtaacagagtctttaaatttaagttggattttgtaaattgttttgtatattttatttaatgtactcttaacaactgatgtatctggctttaaaacatcagaattggtttgttgttttgtttggtacagaggagcatttggtagtgttcattttaattttattatataggagctgaaacatcaaatatatattttatctatcattatgctacacaatcagtgctataaatttttttatgcaaagaaactttcttaatgttttaatcatgtttcctcagagtgacactttttgttgttgttaataccaagtatgaacactctgcatcattattccatgaaccagttctaatgcaaacctatgtatgtccattagaaatggaagttattttttaatcaacaatgaggcctattataaatttatcagatgaatctagatagctttatagcatataaaatatgttaatttgtgttagcaggtgcacatttcaccactgaaattagaaatattttgacagtctgttctgcataccattctgagtctacttttctgtctttagaagaatcgtaaatttcagtgtcctttatttgactcagtgggatatagctgttataagtaatagggcacagatgtgcagtagagtcttgtttaatggcatttcactgttcattccctttaccaccgttataaaacttttctttattgtaattatcagtgcaaagctatgtatttatcatggtaaaactccagtgttagaatagttttttcttacagtatactttctttggttaggtttgtgtatgtgttgctgattacattagaacttgatgttaagtcatttatcacactctcatgagagcagtaataaaagtgtgtaatctaggagaaaaagttaatttgtcaaacttagataagcatgatgtttaggtcctatttttcaattttataactgttttattgcaacaatatttgtatttaagtctccattttaatgccttgtggtgtttttttatgcatgtcactaagttgtcatcccacataaattgatgtgcagcatagggtattaaatctacataatgattttaaaacagaaatagttgatggtaaaatgtaaatgttttgcaaaaattccttataaaaagttttgtagtaacatttcacttgtaaattttttttgtaaaaaaaaaaaaatgaaaaaaaaagatgaatccagaaaaaaacctgtttcccatattctagaatttagacaattattctgccagcaaagcctctggggctgtaattgacatttttacagtgctgatttgtataaaatttgttttttgtggatttggaaataaaatcatgtacaagttgttgcctgcaataacaattgcaagtaacctattaaaaattcccttgagtttaacatgtttcatttaattatgtatactataaagcagcaataaattatttgaactatcaaccta

SEQ ID NO: 29565 - DNA, 806 bp, Homo sapiens
gagtcagccgggctcgggcggagagaggagctgctacgccacagcccagcggcggccattcgcggaaaaagaggcagagcctgtgccagctacagcctcctccgagccaccgcgggcgggcgggaccggcctctcctcccgcctcgcccccacccccacccacctctatcccagtgtctccgtctgagggtttgtcctgttaatgcgggatgagcgatcagaagaaggaggaggaggaggaggcggcagcggcagcggcgatggctacagaaggagggaaaacctctgagccagagaataacaataaaaaacccaaaacctcaggctcccaggactctcagccctctcctctggctttactggcagctacttgcagcaaaatagggactcctggtgaaaatcaagcaactggacaacaacaacgcaacttgctggaaacgcttggcaacttgttgcctccactcctcctgcttcaaaagagaataacgtttctcaaccagcctctagttcgtctagttcttccagcagtaataacgggagtgcatctcctacaaaaactaaatcaggtaattcttccacccctggtcaatttcaagtcatacaagtacaaaatccaagtggtagtgtacagtaccaagtaattccacaacttcagacagtggaaggtcaacaaattcaaatcaatccaactagtagttcatctctacaggatttgcagggtcaaattcagctcatttctgcaggtaataatcaagctatactcacagctgctaacaggacagcttctgggaatattcttgctcaaa

SEQ ID NO: 29566 - DNA, 2971 bp, Homo sapiens
attctcccattctccctccctctcccttttctctctctaccccccccaccccccggctcagctctctccatctgcctggctccttgggacccgttccccagcctcaggatggcgtcctccctgcttgaggaggaagttcactatggctccagtcccctggccatgctgacggcagcgtgcagcaaatttggtggctctagccctctgcgggactcaacaactctgggcaaagcaggcacaaagaagccgtactctgtgggcagtgacctttcagcctccaaaaccatgggggatgcttatccagccccctttacaagcactaatgggctcctttcacctgcaggcagtcctccagcacccacctcaggctatgctaatgattaccctcccttttcccactcattccctgggcccacaggcacccaggaccctgggctactagtgcccaaggggcacagctcttctgactgtctgcccagtgtctacacctctctggacatgacacacccctatggctcctggtacaaggcaggcatccatgcaggcatttcaccaggcccaggcaacactcctactccatggtgggatatgcaccctggaggcaactggctaggtggtgggcagggccagggtgatgggctgcaagggacactgcccacaggtccagctcagcctccactgaacccccagctgcccacctacccatctgactttgctccccttaatccagccccctacccagctccccacctcttgcaaccagggccccagcatgtcttgccccaagatgtctataaacccaaggcagtgggaaatagtgggcagctagaagggagtggtggagccaaacccccacggggtgcaagcactgggggtagtggtggatatgggggcagtggggcagggcgctcctcctgcgactgccctaattgccaggagctagagcggctgggagcagcagcggctgggctgcggaagaagcccatccacagctgccacatccctggctgcggcaaggtgtatggcaaggcttcgcacctgaaggcccacttgcgctggcacacaggcgagaggcccttcgtctgcaactggctcttctgcggcaagaggttcactcgttcggatgagctggagcgtcatgtgcgcactcacacccgggagaagaagttcacctgcctgctctgctccaagcgctttacccgaagcgaccacctgagcaaacaccagcgcacccatggagaaccaggcccgggtccccctcccagtggccccaaggagctgggggagggccgcagcacgggggaagaggaggccagtcagacgccccgaccttctgcctcgccagcaaccccagagaaagcccctggaggcagccctgagcagagcaacttgctggagatctgagccgggtggaaggtctcccaccccagggctgccctgacagtctctcttggctctctagaccactgcttgccaatcactctctttaccccatgcatgccatccttcggggctctctccctctgtctccctcctggccattctgggcttgggtatctccttgcatgcctcctcagctcaccttctctcttcaccatgagactggctttccacaaactctcatctcaggccctccccttgtgcctgatacctgcactccggcttcctagactctggccctgccacaccaacacactttctatttgggctcccaacactatttctccatctcactccttgacatgtacccctttctgcttctcaagcttatttcctgctgtccctcagcctccaggcttcagtcttcccaacttcttacaccattgctttccattctccagaactcttttttcctttttacaaacacaatgataatgataatttattgccccctggtggcctcttcatcaggggtattggggttagtgacctggccagagggtgccaagaggggggcagaccagtggggatctgatcccaaagatggggtgaccccagggtcagggaggctgcccccaggcctgtatatttaacccctatgtaccaggagtaatgaatagtaataattctatttatgtaagttatgatgacgggtcaggtagagtgagctggggagggaagtggatccatttctgctaaggaaattctagtcaaatgcatctctgtatagacaaaatgttagtggagaagatcttgttaatagaatgtctatcatcagaatctcagttgatagggtttctcttgtaatgaagtctctacaaattgggttagctacatctctgctaaacagttgatggggtatctcttgattagggggatccctaatatccccagccccagccagaagctgtgaaacctcaagtcctatggaggggagaaggactggaatgtaccccatctcccttgactgcagagcaggttcctccactgccccaccccttagacaccatgaccccatcaggttaatcccctgttgccatggttatggagagcttgcagctgccatcttagatgtgctctttggggaagcccatctaacaggaggacattggtttgggggtgcacctcctgaagaatgggtggggaaggctttctctaggatcagattcaaataagtatgtattgagtgcctactctgtgcaaggcactatgctagatctggtgcctagaagccctgagaaagaacttaaagagctaggaggacagaggcccccaagctgatctggtggtgcatccacgcacccccaccctgggactttggatgctcccatctccacctccagtgacttttaaagccgcttcgtgcctttcctgtaacgttggatcctccttttctgtcccctgctgtctcaaggccccaagttaaagggttaaagccgctggagcttggggagagaacattgtggaatggaagggatcatgccctttgtggagtcttttttttttaatttaataaataaaagttggattt

SEQ ID NO: 29567 - DNA, 3148 bp, Homo sapiens
ggcgggcggcagcagcctaggcagcagcagtagcagaagcagcagccgccgagcagcagcaaggactctggagtcagagtaggactgtaggaccggagcctgagtggaacaggagtggagctggcctgggagagagcggatccctcccagcaccctcaggccacccgttgcctgcactctccctgccagacctccagagaggagagactcgggacagccagccccaggttcccccagctctctccatctgcctggctccttgggacccgttccccagcctcaggatggcgtcctccctgcttgaggaggaagttcactatggctccagtcccctggccatgctgacggcagcgtgcagcaaatttggtggctctagccctctgcgggactcaacaactctgggcaaagcaggcacaaagaagccgtactctgtgggcagtgacctttcagcctccaaaaccatgggggatgcttatccagccccctttacaagcactaatgggctcctttcacctgcaggcagtcctccagcacccacctcaggctatgctaatgattaccctcccttttcccactcattccctgggcccacaggcacccaggaccctgggctactagtgcccaaggggcacagctcttctgactgtctgcccagtgtctacacctctctggacatgacacacccctatggctcctggtacaaggcaggcatccatgcaggcatttcaccaggcccaggcaacactcctactccatggtgggatatgcaccctggaggcaactggctaggtggtgggcagggccagggtgatgggctgcaagggacactgcccacaggtccagctcagcctccactgaacccccagctgcccacctacccatctgactttgctccccttaatccagccccctacccagctccccacctcttgcaaccagggccccagcatgtcttgccccaagatgtctataaacccaaggcagtgggaaatagtgggcagctagaagggagtggtggagccaaacccccacggggtgcaagcactgggggtagtggtggatatgggggcagtggggcagggcgctcctcctgcgactgccctaattgccaggagctagagcggctgggagcagcagcggctgggctgcggaagaagcccatccacagctgccacatccctggctgcggcaaggtgtatggcaaggcttcgcacctgaaggcccacttgcgctggcacacaggcgagaggcccttcgtctgcaactggctcttctgcggcaagaggttcactcgttcggatgagctggagcgtcatgtgcgcactcacacccgggagaagaagttcacctgcctgctctgctccaagcgctttacccgaagcgaccacctgagcaaacaccagcgcacccatggagaaccaggcccgggtccccctcccagtggccccaaggagctgggggagggccgcagcacgggggaagaggaggccagtcagacgccccgaccttctgcctcgccagcaaccccagagaaagcccctggaggcagccctgagcagagcaacttgctggagatctgagccgggtggaaggtctcccaccccagggctgccctgacagtctctcttggctctctagaccactgcttgccaatcactctctttaccccatgcatgccatccttcggggctctctccctctgtctccctcctggccattctgggcttgggtatctccttgcatgcctcctcagctcaccttctctcttcaccatgagactggctttccacaaactctcatctcaggccctccccttgtgcctgatacctgcactccggcttcctagactctggccctgccacaccaacacactttctatttgggctcccaacactatttctccatctcactccttgacatgtacccctttctgcttctcaagcttatttcctgctgtccctcagcctccaggcttcagtcttcccaacttcttacaccattgctttccattctccagaactcttttttcctttttacaaacacaatgataatgataatttattgccccctggtggcctcttcatcaggggtattggggttagtgacctggccagagggtgccaagaggggggcagaccagtggggatctgatcccaaagatggggtgaccccagggtcagggaggctgcccccaggcctgtatatttaacccctatgtaccaggagtaatgaatagtaataattctatttatgtaagttatgatgacgggtcaggtagagtgagctggggagggaagtggatccatttctgctaaggaaattctagtcaaatgcatctctgtatagacaaaatgttagtggagaagatcttgttaatagaatgtctatcatcagaatctcagttgatagggtttctcttgtaatgaagtctctacaaattgggttagctacatctctgctaaacagttgatggggtatctcttgattagggggatccctaatatccccagccccagccagaagctgtgaaacctcaagtcctatggaggggagaaggactggaatgtaccccatctcccttgactgcagagcaggttcctccactgccccaccccttagacaccatgaccccatcaggttaatcccctgttgccatggttatggagagcttgcagctgccatcttagatgtgctctttggggaagcccatctaacaggaggacattggtttgggggtgcacctcctgaagaatgggtggggaaggctttctctaggatcagattcaaataagtatgtattgagtgcctactctgtgcaaggcactatgctagatctggtgcctagaagccctgagaaagaacttaaagagctaggaggacagaggcccccaagctgatctggtggtgcatccacgcacccccaccctgggactttggatgctcccatctccacctccagtgacttttaaagccgcttcgtgcctttcctgtaacgttggatcctccttttctgtcccctgctgtctcaaggccccaagttaaagggttaaagccgctggagcttggggagagaacattgtggaatggaagggatcatgccctttgtggagtcttttttttttaatttaataaataaaagttggatttg

SEQ ID NO: 29568 - DNA, 1472 bp, Homo sapiens
agcagccgccgagcagcagcaaggactctggagtcagagtaggactgtaggaccggagcctgagtggaacaggagtggagctggcctgggagagagcggatccctcccagcaccctcaggccacccgttgcctgcactctccctgccagacctccagagaggagagactcgggacagccagccccaggttcccccaggaggaagttcactatggctccagtcccctggccatgctgacggcagcgtgcagcaaatttggtggctctagccctctgcgggactcaacaactctgggcaaagcaggcacaaagaagccgtactctgtgggcagtgacctttcagcctccaaaaccatgggggatgcttatccagccccctttacaagcactaatgggctcctttcacctgcaggcagtcctccagcacccacctcaggctatgctaatgattaccctcccttttcccactcattccctgggcccacaggcacccaggaccctgggctactagtgcccaaggggcacagctcttctgactgtctgcccagtgtctacacctctctggacatgacacacccctatggctcctggtacaaggcaggcatccatgcaggcatttcaccaggcccaggcaacactcctactccatggtgggatatgcaccctggaggcaactggctaggtggtgggcagggccagggtgatgggctgcaagggacactgcccacaggtccagctcagcctccactgaacccccagctgcccacctacccatctgactttgctccccttaatccagccccctacccagctccccacctcttgcaaccagggccccagcatgtcttgccccaagatgtctataaacccaaggcagtgggaaatagtgggcagctagaagggagtggtggagccaaacccccacggggtgcaagcactgggggtagtggtggatatgggggcagtggggcagggcgctcctcctgcgactgccctaattgccaggagctagagcggctgggagcagcagcggctgggctgcggaagaagcccatccacagctgccacatccctggctgcggcaaggtgtatggcaaggcttcgcacctgaaggcccacttgcgctggcacacaggcgagaggcccttcgtctgcaactggctcttctgcggcaagaggttcactcgttcggatgagctggagcgtcatgtgcgcactcacacccgggagaagaagttcacctgcctgctctgctccaagcgctttacccgaagcgaccacctgagcaaacaccagcgcacccatggagaaccaggcccgggtccccctcccagtggccccaaggagctgggggagggccgcagcacgggggaagaggaggccagtcagacgccccgaccttctgcctcgccagcaaccccagagaaagcccctggaggcagccctgagcagagcaacttgctggagatctga

SEQ ID NO: 29569 - DNA, 3495 bp, Homo sapiens
attgtattgcacacctctaaaaaaaacactgcctctgatttatcaatataaaaaagatcctctgagaggaggagggcacttttgtgtgatggcaacttcacttctaggggaagaaccgaggttgggatcgactcctctggccatgcttgccgctacctgtaataagataggcagccccagcccgtctccctcctccctctcggacagctcttcttccttcggcaaaggcttccacccctggaaacgctcctcgtcctcttcttccgccagctgcaacgtagtgggttccagtctctcaagcttcggcgtgtccggggcctccaggaacggcggctcgtcctcggcggctgcggcggccgcggcagcagccgcggctgccgcggccctggtgtccgactcgttcagctgcggcggctcgcctggctccagcgccttctccctcacctccagcggcggctcctccgcgcactcgcaggacggctcccaccagccggtgttcatctccaaggtgcacacctctgtggacgggctgcagggcatctacccgcgggtgggcatggcgcacccgtacgagtcgtggtttaagccctcgcacccgggcctgggtgctgcgggcgaggtgggctcggccggcgcctccagctggtgggacgtgggggccggctggatcgacgtgcagaacccgaacagcgcggctgcgctgcccggctcgctgcaccctgccgccggggggctccaaacctcgctgcactcgccgctcggaggctacaactcggattactcgggcctgagtcactcggccttcagcagcggcgcctcctcgcacctgctcagccccgccgggcagcacctcatggacggcttcaagccagtgctacccggctcctacccggactcggccccgtcgccgctggccggcgcggggggctccatgttgagcgctgggccttcggcgccgctggggggctccccgcgctcctcagctcgccgctactccggccgcgccacctgcgactgccccaactgccaggaggcagagcggctgggccctgccggggcgagcttgcggcgcaagggcctgcacagctgccacatcccgggctgcggcaaggtgtacggcaagacttcgcacctcaaggcgcacctgcgctggcacacgggcgagcggcccttcgtgtgcaactggcttttctgcggcaagcgcttcacgcgctccgacgagctgcagcggcacctgcggacccacaccggcgagaagcgcttcgcctgtccagtttgcaacaagcgcttcatgcgcagcgaccacctcagcaagcacgtgaagacgcacagtggcggcggcggcggcggcggctcggcgggctcgggcagcggcggcaagaagggcagcgacaccgacagcgagcacagcgccgcgggcagcccgccctgccactccccagagctgctgcagccccccgagcccgggcaccgcaacggcctagagtgacgcccaccctgcgcccgcccctctccccgacctcctcccaccaagtcctcttgggccctgtctgtccggacttcaactccagcctttccctattgcatccgactcgctctctgtctctttctgtttctgcccctcttccttcttccttctgtgacttaactttgtaaaggggatatggacaagtaagtaacacgcatcgctgtcccgggccctggctttccctttccacgggtaacgctgcctgaacccgttgcagccggaacccgcgcctcgtcgggcctttatttctcgttctctcttccttgtcctcccctcctccaccccccaggttgtgaagggcgtaacttttagagggaacggccactggaggtagagctggactaatccagtgcctggtagacagcgggcctcgcgcgggcaggagcggctcggctgacaagcctgagcggagcggtggagagggagaggctggaggcctgggcagaacagcgccgcccgggcagacggctgcttggttccagagccgctgtactgagcacctcggcttcggagcaccctgccaggcccctgggcatcgccggacgtcctactcaggctgtcggggcttggtgggggtgacttttggcagcccgagacccagagtttgtagagtttagatctcccaatgtcagtctgcctctttttctttgttccctgaggtggaaccgatgcaagtttcagcaaagggcagtcttgtcgaatcgctgcagcagctttctttcatctttatagcatatattttatttttaaaaaaactagggggaaaatagcaaccttccatttggtttcccttctataatagttttttcctctaacggggagcaatctttctctcgaaactgctaatattgatcccaaagttactttgactgcattaacttaacttacggggtgggggcgggggtgagggtaggtgcttttttcttatgcaaaaatactcctttccggtgagaccagattaactatctccatgtttgtccttttctacctcgttttttcaccactcccaaacataacctcccaatcttttttgttagtccggccgtcaattgtatagtaccaatttcgtaaattctctcaattcatgaagatcgtagggttaaacttttttgtgtgtgatttaaacttacaaacaagtgaagaagctatcgtttatttcagacgaggctgtagtttaaataccaaaagagggaaaataaaaaagaacctttgtaaaatatatctgaacctaatggtttgtacaactggagaatcgttctagattagttaccaattaaatataactccgccagtgtaagggtgtgaggtgcagttgtccaggagacgattttgtatagtatttttcttgtacattacttccagtaaatatttgaaaatatattgaagtaaacttgattttttttttttgtcacaagaaaatattaagagttattgttgcagttctgatgagctgcaggttttttgaactcacttctggaggtgcagagccacaaacgcactttcggggcctagttttgctcgaatatgaatttagataggtatcaagctgtaactaagacaatattgataaatgttggatgacatttaatttaatggagcatgtacttatttgcatttgctggcagttcaggcatagttaaagtgagagttctcctatatttcataataagtggtctgccaaaacccatgtattaaataaattgtccaagtgaaactcgactaactttggcctttgtgtatttcctgaaggtaatattgttaactgttaataaatacttctgacactacatttaaatgtttgcagattctgcaaactaattgctcattgtaatgttgaaataatttggatatttcacattgaaatgaaaagcctttctctggagcattttagatttgcattttaaatgcatgaaatgtaattgatttatttgtaatattttaaatggtataataaactcagataaaag

SEQ ID NO: 29570 - DNA, 1714 bp, Homo sapiens
attgtattgcacacctctaaaaaaaacactgcctctgatttatcaatataaaaaagatcctctgagaggaggagggcacttttgtgtgatggcaacttcacttctagggcgtggtgcttgctcccgaatcagacgccggcagccaaacttgtcccctcctgtagagtaggaagcggccgggcgccggggctgttgggggtgccaggaagaaccgaggttgggatcgactcctctggccatgcttgccgctacctgtaataagataggcagccccagcccgtctccctcctccctctcggacagctcttcttccttcggcaaaggcttccacccctggaaacgctcctcgtcctcttcttccgccagctgcaacgtagtgggttccagtctctcaagcttcggcgtgtccggggcctccaggaacggcggctcgtcctcggcggctgcggcggccgcggcagcagccgcggctgccgcggccctggtgtccgactcgttcagctgcggcggctcgcctggctccagcgccttctccctcacctccagcagcgccgcagccgccgccgccgccgccgcagccgccgcctccagctcgcccttcgccaacgactactctgttttccaggcccccggagtttccgggggcagcggcggcggcggcgggggcggcggcggcggctcctccgcgcactcgcaggacggctcccaccagccggtgttcatctccaaggtgcacacctctgtggacgggctgcagggcatctacccgcgggtgggcatggcgcacccgtacgagtcgtggtttaagccctcgcacccgggcctgggtgctgcgggcgaggtgggctcggccggcgcctccagctggtgggacgtgggggccggctggatcgacgtgcagaacccgaacagcgcggctgcgctgcccggctcgctgcaccctgccgccggggggctccaaacctcgctgcactcgccgctcggaggctacaactcggattactcgggcctgagtcactcggccttcagcagcggcgcctcctcgcacctgctcagccccgccgggcagcacctcatggacggcttcaagccagtgctacccggctcctacccggactcggccccgtcgccgctggccggcgcggggggctccatgttgagcgctgggccttcggcgccgctggggggctccccgcgctcctcagctcgccgctactccggccgcgccacctgcgactgccccaactgccaggaggcagagcggctgggccctgccggggcgagcttgcggcgcaagggcctgcacagctgccacatcccgggctgcggcaaggtgtacggcaagacttcgcacctcaaggcgcacctgcgctggcacacgggcgagcggcccttcgtgtgcaactggcttttctgcggcaagcgcttcacgcgctccgacgagctgcagcggcacctgcggacccacaccggcgagaagcgcttcgcctgtccagtttgcaacaagcgcttcatgcgcagcgaccacctcagcaagcacgtgaagacgcacagtggcggcggcggcggcggcggctcggcgggctcgggcagcggcggcaagaagggcagcgacaccgacagcgagcacagcgccgcgggcagcccgccctgccactccccagagctgctgcagccccccgagcccgggcaccgcaacggcctagagtgacgc

SEQ ID NO: 29571 - DNA, 1618 bp, Homo sapiens
attgtattgcacacctctaaaaaaaacactgcctctgatttatcaatataaaaaagatcctctgagaggaggagggcacttttgtgtgatggcaacttcacttctaggggaagaaccgaggttgggatcgactcctctggccatgcttgccgctacctgtaataagataggcagccccagcccgtctccctcctccctctcggacagctcttcttccttcggcaaaggcttccacccctggaaacgctcctcgtcctcttcttccgccagctgcaacgtagtgggttccagtctctcaagcttcggcgtgtccggggcctccaggaacggcggctcgtcctcggcggctgcggcggccgcggcagcagccgcggctgccgcggccctggtgtccgactcgttcagctgcggcggctcgcctggctccagcgccttctccctcacctccagcagcgccgcagccgccgccgccgccgccgcagccgccgcctccagctcgcccttcgccaacgactactctgttttccaggcccccggagtttccgggggcagcggcggcggcggcgggggcggcggcggcggctcctccgcgcactcgcaggacggctcccaccagccggtgttcatctccaaggtgcacacctctgtggacgggctgcagggcatctacccgcgggtgggcatggcgcacccgtacgagtcgtggtttaagccctcgcacccgggcctgggtgctgcgggcgaggtgggctcggccggcgcctccagctggtgggacgtgggggccggctggatcgacgtgcagaacccgaacagcgcggctgcgctgcccggctcgctgcaccctgccgccggggggctccaaacctcgctgcactcgccgctcggaggctacaactcggattactcgggcctgagtcactcggccttcagcagcggcgcctcctcgcacctgctcagccccgccgggcagcacctcatggacggcttcaagccagtgctacccggctcctacccggactcggccccgtcgccgctggccggcgcggggggctccatgttgagcgctgggccttcggcgccgctggggggctccccgcgctcctcagctcgccgctactccggccgcgccacctgcgactgccccaactgccaggaggcagagcggctgggccctgccggggcgagcttgcggcgcaagggcctgcacagctgccacatcccgggctgcggcaaggtgtacggcaagacttcgcacctcaaggcgcacctgcgctggcacacgggcgagcggcccttcgtgtgcaactggcttttctgcggcaagcgcttcacgcgctccgacgagctgcagcggcacctgcggacccacaccggcgagaagcgcttcgcctgtccagtttgcaacaagcgcttcatgcgcagcgaccacctcagcaagcacgtgaagacgcacagtggcggcggcggcggcggcggctcggcgggctcgggcagcggcggcaagaagggcagcgacaccgacagcgagcacagcgccgcgggcagcccgccctgccactccccagagctgctgcagccccccgagcccgggcaccgcaacggcctagagtgacgc

SEQ ID NO: 29572 - DNA, 691 bp, Homo sapiens
attaaacatggagaaatgaggagcggcggcagatcggtttgggatgcatcttcaggggatgctgaaacaacagcagcatttggtttgctctacacccctgtcacccctcgcccgcaagcccagggagtggtcagcagtggggctttgtgatgtgaagccaccctagggctgccattggctgggacactgcctgtatgatcaaacaaagctcaagggtgtggctttgccttgtcaccaggagggtatacatagggagggcaagagctccgggccactgagaagattcaaaacctacaaaagcctgccactgacattgaagaaccaatatatacaatggacaaacaatccagtgccggcggggtgaagaggagcgtcccctgtgattccaacgaggccaacgagatgatgccggagaccccaactggggactcagacccgcaacctgctcctaaaaaaatgaaaacatctgagtcctcgaccatactagtggttcgctacaggaggaactttaaaagaacatctccagaggaactgctgaatgaccacgcccgagagaacagaatcaaccccctccaaatggaggaggaggaattcatggaaataatggttgaaatacctgcaaagtagcaagaagctacatctctcaaccttgggcaatgaaaataaagtttgagaagctgatggctgtgta

SEQ ID NO: 29573 - DNA, 387 bp, Homo sapiens
caaaagcctgccgcagacattgaagaaccaatatatacaatggacaaacaatccagtgccggcggggtgaagaggagcgtcccctgtgaatccaacgaggtgaatgagacgatgccggagaccccaactggggactcagacccgcaacctgctcctaaaaaaatgaaaacatctgagtcctcgaccatactagtggttcgctacaggaggaacgtgaaaagaacatctccagaggaactgctgaatgaccacgcccgagagaacagaatcaaccccctccaaatggaggaggaggaattcatggaaataatggttgaaatacctgcaaagtagcaagaagctacatctctcaaccttgggcaatgaaaataaagtttgagaagctga

SEQ ID NO: 29574 - DNA, 2040 bp, Homo sapiens
aggcgtccaacctgctgccgcctgggccccgccgagcggagctagcgccgcgcgcagagcacacgctcgcgctccagctcccctcctgcgcggttcatgactgtgtcccctgaccgcagcctctgcgagcccccgccgcaggaccacggcccgctccccgccgccgcgagggccccgagcgaaggaaggaagggaggcgcgctgtgcgccccgcggagcccgcgaaccccgctcgctgccggctgcccagcctggctggcaccatgctgcccgcgcgctgcgcccgcctgctcacgccccacttgctgctggtgttggtgcagctgtcccctgctcgcggccaccgcaccacaggccccaggtttctaataagtgaccgtgacccacagtgcaacctccactgctccaggactcaacccaaacccatctgtgcctctgatggcaggtcctacgagtccatgtgtgagtaccagcgagccaagtgccgagacccgaccctgggcgtggtgcatcgaggtagatgcaaagatgctggccagagcaagtgtcgcctggagcgggctcaagccctggagcaagccaagaagcctcaggaagctgtgtttgtcccagagtgtggcgaggatggctcctttacccaggtgcagtgccatacttacactgggtactgctggtgtgtcaccccggatgggaagcccatcagtggctcttctgtgcagaataaaactcctgtatgttcaggttcagtcaccgacaagcccttgagccagggtaactcaggaaggaaagatgacgggtctaagccgacacccacgatggagacccagccggtgttcgatggagatgaaatcacagccccaactctatggattaaacacttggtgatcaaggactccaaactgaacaacaccaacataagaaattcagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaagtaggacgcctcgtctaaggagcagaaaacccaagggcaggtggagagtccagggaggcaggatggatcaccagacacctaaccttcagcgttgcccatggccctgccacatcccgtgtaacataagtggtgcccaccatgtttgcacttttaataactcttacttgcgtgttttgtttttggtttcattttaaaacaccaatatctaataccacagtgggaaaaggaaagggaagaaagactttattctctctcttattgtaagtttttggatctgctactgacaacttttagagggttttgggggggtgggggagggtgttgttggggctgagaagaaagagatttatatgctgtatataaatatatatgtaaattgtatagttcttttgtacaggcattggcattgctgtttgtttatttctctccctctgcctgctgtgggtggtgggcactctggacacatagtccagctttctaaaatcca

SEQ ID NO: 29575 - DNA, 3666 bp, Homo sapiens
cctgctgccgcctgggccccgccgagcggagctagcgccgcgcgcagagcacacgctcgcgctccagctcccctcctgcgcggttcatgactgtgtcccctgaccgcagcctctgcgagcccccgccgcaggaccacggcccgctccccgccgccgcgagggccccgagcgaaggaaggaagggaggcgcgctgtgcgccccgcggagcccgcgaaccccgctcgctgccggctgcccagcctggctggcaccatgctgcccgcgcgctgcgcccgcctgctcacgccccacttgctgctggtgttggtgcagctgtcccctgctcgcggccaccgcaccacaggccccaggtttctaataagtgaccgtgacccacagtgcaacctccactgctccaggactcaacccaaacccatctgtgcctctgatggcaggtcctacgagtccatgtgtgagtaccagcgagccaagtgccgagacccgaccctgggcgtggtgcatcgaggtagatgcaaagatgctggccagagcaagtgtcgcctggagcgggctcaagccctggagcaagccaagaagcctcaggaagctgtgtttgtcccagagtgtggcgaggatggctcctttacccaggtgcagtgccatacttacactgggtactgctggtgtgtcaccccggatgggaagcccatcagtggctcttctgtgcagaataaaactcctgtatgttcaggttcagtcaccgacaagcccttgagccagggtaactcaggaaggaaagatgacgggtctaagccgacacccacgatggagacccagccggtgttcgatggagatgaaatcacagccccaactctatggattaaacacttggtgatcaaggactccaaactgaacaacaccaacataagaaattcagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaaggacgcctcgtctaaggagcagaaaacccaagggcaggtggagagtccagggaggcaggatggatcaccagacacctaaccttcagcgttgcccatggccctgccacatcccgtgtaacataagtggtgcccaccatgtttgcacttttaataactcttacttgcgtgttttgtttttggtttcattttaaaacaccaatatctaataccacagtgggaaaaggaaagggaagaaagactttattctctctcttattgtaagtttttggatctgctactgacaacttttagagggttttgggggggtgggggagggtgttgttggggctgagaagaaagagatttatatgctgtatataaatatatatgtaaattgtatagttcttttgtacaggcattggcattgctgtttgtttatttctctccctctgcctgctgtgggtggtgggcactctggacacatagtccagctttctaaaatccaggactctatcctgggcctactaaacttctgtttggagactgacccttgtgtataaagacgggagtcctgcaattgtactgcggactccacgagttcttttctggtgggaggactatattgccccatgccattagttgtcaaaattgataagtcacttggctctcggccttgtccagggaggttgggctaaggagagatggaaactgccctgggagaggaagggagtccagatcccatgaatagcccacacaggtaccggctctcagagggtccgtgcattcctgctctccggacccccaaagggcccagcattggtgggtgcaccagtatcttagtgaccctcggagcaaattatccacaaaggatttgcattacgtcactcgaaacgttttcatccatgcttagcatctactctgtataacgcatgagaggggaggcaaagaagaaaaagacacacagaagggcctttaaaaaagtagatatttaatatctaagcaggggaggggacaggacagaaagcctgcactgaggggtgcggtgccaacagggaaactcttcacctccctgcaaacctaccagtgaggctcccagagacgcagctgtctcagtgccaggggcagattgggtgtgacctctccactcctccatctcctgctgttgtcctagtggctatcacaggcctgggtgggtgggttgggggaggtgtcagtcaccttgttggtaacactaaagttgttttgttggttttttaaaaacccaatactgaggttcttcctgttccctcaagttttcttatgggcttccaggctttaagctaattccagaagtaaaactgatcttgggtttcctattctgcctcccctagaagggcaggggtgataacccagctacagggaaatcccggcccagctttccacaggcatcacaggcatcttccgcggattctagggtgggctgcccagccttctggtctgaggcgcagctccctctgcccaggtgctgtgcctattcaagtggccttcaggcagagcagcaagtggcccttagcgccccttcccataagcagctgtggtggcagtgagggaggttgggtagccctggactggtcccctcctcagatcacccttgcaaatctggcctcatcttgtattccaacccgacatccctaaaagtacctccacccgttccgggtctggaaggcgttggcaccacaagcactgtccctgtgggaggagcacaaccttctcgggacaggatctgatggggtcttgggctaaaggaggtccctgctgtcctggagaaagtcctagaggttatctcaggaatgactggtggccctgccccaacgtggaaaggtgggaaggaagccttctcccattagccccaatgagagaactcaacgtgccggagctgagtgggccttgcacgagacactggccccactttcaggcctggaggaagcatgcacacatggagacggcgcctgcctgtagatgtttggatcttcgagatctccccaggcatcttgtctcccacaggatcgtgtgtgtaggtggtgttgtgtggttttcctttgtgaaggagagagggaaactatttgtagcttgttttataaaaaataaaaaatgggtaaatcttg

SEQ ID NO: 29576 - DNA, 3150 bp, Homo sapiens
gggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagtctccttgcaaatcttttccgttctgaattcagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccacatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaactata

SEQ ID NO: 29577 - DNA, 3117 bp, Homo sapiens
gggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccacatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaactata

SEQ ID NO: 29578 - DNA, 1564 bp, Homo sapiens
gggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacaggaaaatccaagaaaagaaggg

SEQ ID NO: 29579 - DNA, 672 bp, Homo sapiens
aaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacaggatgcaatggtggtgtcctccagacccaaagccacaacccatcgcaagtcaagaacactttccagaagataaacatgagtgggttcatgtctctctccttcaaagccaggacaaaatccccacttctttgctgccgcgagtcaatttgtgatttattttgtctgcacctgtttgatgccaggtcgacatttcctaaggcaagcccctgtatttgttgtggatttaagtggaggcggccagcacacaccttggatgtaatttaaaaccatttcctgaggaaagatgtgtgatatgctttcctttgtttagcaaatgtttatggttttaactttaaatctcaccgcaaatcacttacacttgaaaacagggctggtctgaaagtaattaccctccctgagtgccaagacctccagaagttgttttcattcccgaatggcaatcactgtactcatgcgctccacgcatcttaaataaactcagttcaaagca

SEQ ID NO: 29580 - DNA, 5328 bp, Homo sapiens
agttgttatacggcttttgtcttaacgaagccacccattacggtatgatgatgtcaaacgtgatgctgatgctacagttacagcccctgctggcgcagcctctctgattctctctccctctccgcgtccagtgctgggctttttcagacaagtgcatctcctaaccaggtcacatttcagccgcgacccactctccgccagtcaccggaggcagaccgcgggaggagagctgaggacagccgcgtgcgcttcgccagcagcggggtgggaggaaggacattaaaatactgcagaagtcaagacccccccaggtcgaacccagaccacgatgcgcgccccgggctgcgggcggctggtgctgccgctgctgctcctggccgcggcagccctggccgaaggcgacgccaaggggctcaaggagggcgagacccccggcaatttcatggaggacgagcaatggctgtcgtccatctcgcagtacagcggcaagatcaagcactggaaccgcttccgagacgaagtggaggatgactatatcaagagctgggaggacaatcagcaaggagatgaagccctggataccaccaaggacccctgccagaaggtgaagtgcagccgccacaaggtgtgcattgcccagggctaccagcgggccatgtgcatcagtcgcaagaagctggagcacaggatcaagcagccgaccgtgaaactccatggaaacaaagactccatctgcaagccctgccacatggcccagcttgcctctgtctgcggctcagatggccacacttacagctctgtgtgtaagctggagcaacaggcgtgcctgagcagcaagcagctggcggtgcgatgcgagggcccctgcccctgccccacggagcaggctgccacctccaccgccgatggcaaaccagagacttgcaccggtcaggacctggctgacctgggagatcggctgcgggactggttccagctccttcatgagaactccaagcagaatggctcagccagcagtgtagccggcccggccagcgggctggacaagagcctgggggccagctgcaaggactccattggctggatgttctccaagctggacaccagtgctgacctcttcctggaccagacggagctggccgccatcaacctggacaagtacgaggtctgcatccgtcccttcttcaactcctgtgacacctacaaggatggccgggtctctactgctgagtggtgcttctgcttctggagggagaagcccccctgcctggcagagctggagcgcatccagatccaggaggccgccaagaagaagccaggcatcttcatcccgagctgcgacgaggatggctactaccggaagatgcagtgtgaccagagcagcggtgactgctggtgtgtggaccagctgggcctggagctgactggcacgcgcacgcatgggagccccgactgcgatgacatcgtgggcttctcgggggactttggaagcggtgtcggctgggaggatgaggaggagaaggagacggaggaagcaggcgaggaggccgaggaggaggagggcgaggcaggcgaggctgacgacgggggctacatctggtagacgccctcaggagccggctgccgggggggactcaacagcagagctctgagcagcagcaggcaacttcgagaacggatccagaaatgcagtcagaaggaccctgctccacctggggggactgggagtgtgagtgtgcatggcatgtgtgtggcacagatggctgggacgggtgacagtgtgagtgcatgtgtgcatgcatgtgtgtatgtgtgtgtgtgtgtggcatgcgctgacaaatgtgtccttgatccacactgctcctggcagagtgagtcacccaaaggccccttcggcctccttgtagctgttttctttccttttgttgttggttttaaaatacattcacacacaaatacaaattgacaggtcaaaatccatgaaatgagatcccccagccgtgtcctccagcccagccctgaccccttggtttctaccctggctccccttggtttctaccctggctcaaccgacccctgtctgcccttctccctcttgcttctgaggtcaagctctggcctgcgagcctgtccccattgcaaaggggagggaggggcagggagctgtctaccagctgaggtcctcccaaaactgggccgatgtggtgtgacatccccaccagcctcagatgagacgggccaggacgcccagccacagcaagccctgtccctttgccggatccccaaacactagagaagctctcctaacccaaggcggagaatgaaggtggtggcggcagaggaggagggcagcagctgagaggccagggacagggtgcctcgccaagctgtctgaggtctgtcccaggtggcccaggtggtgcaggtagaacagggtgaggagagggggtcggctcagcaggaggaggctgtggctgcagagcctgggggagcttttaggtgttgagatggggcagctctgaatcctagaccctggaatagcctgtcccttttctctgggtctcgtggtggagccatgatctgggctgctctcttggggacactgggtggtggttacacagttgacctctgcctggctcccccttggtgcaactcctgcctccatcccccttgctggggtcccctcatccacttgagggcgcctgagggccaggagcagcaggcaaggagcctgggtctaggctaagggggtgtgtgcccacctcctccctgacccttaacactcctgtcctgcccagaccaacagagagagctgtccctgagaccccggagagaagcagctgccgaaagctgcagcctttccgcactctgagaccatgatcttcctcctgccaggggagagccacccacaggccatgtccagccccacttccctcagcccccagggcttccttctggcccctctgaggattccctagggctgccccgcagaggggcttccccaagctctgttttgaagcctgcaatgtggaaaagtgagaagtcagagggaacaggacaggtgcagccgggctctgaggccacacctcacacctcgctgttccccaacatcccctgagcagtgtgagctcatctcaccagatgagaagaggccctgtgcatttcttttgtttgtttgttgctgttttcccccacccatccagttctcctcagcaaagcaaattccttaacacctttggtggagaatttcttacccagacttggggctgtgatgcccttcagtgcgtggtgagtgcagcgtgtgtgcgtgtgcctgtgtgtgaacctgggggccatcctggtggcctgggagcgtgaggagaggccccctgtgtgctgggtgagtggtgggtgtggggtcaatgcagtgaggctctctgggtgaggctcccaacctggcagtccccagcctcccagcatctgtgagcgtctgttggactttacagaagagcctcatcctgtctgcccctcactctgccctggaatcaacatcttccgagtccttcttgggggaaatagcagagccccacttaactccataaactgcttcccattccgcagcccagttctgattgttgaggtgtcgcgtcgttccaggtcccccagtcccctctttctcctgtcctctctctgtccttcacctccccactccagccccggctcagttcagggaaatgctgttccacatcagccctctgctctctgaggcagccgcgcctctgactcggagctacttgaaacttctgctcttgctaggattggagtctacctatctcttccatttgtcccagctggagttctggaactttcctcctcggggtgggggtgggggttgttaaggatgctggggggcctggggaaggaaggagttcagaggaagggtgtcccctgtcctcttgatgtcaccctccgctcctgggacacgtgctctctctgtctctgggtcttctggctgtgcacgtttgtgtgtccttgtaaatatgttttaggaagaaagcaaaagggactgaactagcctctggtaggattgcaggggtccagccttgcctgtttccgaagcccccacactgcctttcgccctactgagactggtcccctcaaaaggtagacaaaacagcagctccctgtggagctgaagggcggcctcaaagtggctttttgttagacaaggttaaggtttcctcatgagcaaggttgcagatcggtccttcctcagctccttgatttgtgaccttgaccaaggggcctgccacccagcccctccagtgccctctcctcgatgcctcgctccttcctgcccccactcccctggcttaggcaggtaggggaattagggccatgctggaagaagcttaaccatgtgttcaaagaacggtttcttgcttgcttggtcctggaactccccttggctgccccaggcctccttggcccatgggtgctgggggaggtggatgtcagatctggtaggttgcagcagagaaaataaatgtgccttgagagaccactcagagagggtccaagggtgatggagaaggaagcatggcctgggagcttggaagggaggggtggtgggtggcggcatcttgactgccccctgttgtcccacacgtggggggtggtcaccccccttcactccagcccgcctgccttcagccttccatgagcttcacctgcttccaacttcactttggagggggtggggtccgttggcatcaacacggggaccctctgcttcaccaaagcccgagccctcagcccctggggagaacaaatggctgagctttgatacctggggtcgtcgagaggctgcgggctggcggcagtcccaggggagagacaccacagaaggagacccagacatcccgaggaagttcccagcagagcaaactgctttccagcctgaagcctgcttaaactgtgtgatgtgcaataactgagcttagagttaggaattgtgttcaagtgcttggatttccgtctgtagatttaactgctgaaattgtatctctcagtaattttagatgtcttttaaaaaattgaaaaacaaagtgttagactgtgtgcgtgtgcgttgatgggcactcaagagtcccgtgagtcatccagccctgcctttcccctgcgcccccatcctctcacgtcccgccccgcctccacttggggaccctgcctcgtgtcgtctttatctgcctattactcagcctaaggaaacaagtacactccacacatgcataaaggaaatcaaatgttatttttaagaaaatggaaaataaaaactttataaacacc

SEQ ID NO: 29581 - DNA, 5436 bp, Homo sapiens
cagggacatttcgggattctggatttcttggtctgcaactccctgtgtgccaggcggggctgggccccgctgcggctggctggcgtttggcgctctcatcgagggagcgcttcgctttgaaatctacccactccttttttttttttttttttaaaccaggtatgatgatgtcaaacgtgatgctgatgctacagttacagcccctgctggcgcagcctctctgattctctctccctctccgcgtccagtgctgggctttttcagacaagtgcatctcctaaccaggtcacatttcagccgcgacccactctccgccagtcaccggaggcagaccgcgggaggagagctgaggacagccgcgtgcgcttcgccagcagcggggtgggaggaaggacattaaaatactgcagaagtcaagacccccccaggtcgaacccagaccacgatgcgcgccccgggctgcgggcggctggtgctgccgctgctgctcctggccgcggcagccctggccgaaggcgacgccaaggggctcaaggagggcgagacccccggcaatttcatggaggacgagcaatggctgtcgtccatctcgcagtacagcggcaagatcaagcactggaaccgcttccgagacgatgactatatcaagagctgggaggacaatcagcaaggagatgaagccctggataccaccaaggacccctgccagaaggtgaagtgcagccgccacaaggtgtgcattgcccagggctaccagcgggccatgtgcatcagtcgcaagaagctggagcacaggatcaagcagccgaccgtgaaactccatggaaacaaagactccatctgcaagccctgccacatggcccagcttgcctctgtctgcggctcagatggccacacttacagctctgtgtgtaagctggagcaacaggcgtgcctgagcagcaagcagctggcggtgcgatgcgagggcccctgcccctgccccacggagcaggctgccacctccaccgccgatggcaaaccagagacttgcaccggtcaggacctggctgacctgggagatcggctgcgggactggttccagctccttcatgagaactccaagcagaatggctcagccagcagtgtagccggcccggccagcgggctggacaagagcctgggggccagctgcaaggactccattggctggatgttctccaagctggacaccagtgctgacctcttcctggaccagacggagctggccgccatcaacctggacaagtacgaggtctgcatccgtcccttcttcaactcctgtgacacctacaaggatggccgggtctctactgctgagtggtgcttctgcttctggagggagaagcccccctgcctggcagagctggagcgcatccagatccaggaggccgccaagaagaagccaggcatcttcatcccgagctgcgacgaggatggctactaccggaagatgcagtgtgaccagagcagcggtgactgctggtgtgtggaccagctgggcctggagctgactggcacgcgcacgcatgggagccccgactgcgatgacatcgtgggcttctcgggggactttggaagcggtgtcggctgggaggatgaggaggagaaggagacggaggaagcaggcgaggaggccgaggaggaggagggcgaggcaggcgaggctgacgacgggggctacatctggtagacgccctcaggagccggctgccgggggggactcaacagcagagctctgagcagcagcaggcaacttcgagaacggatccagaaatgcagtcagaaggaccctgctccacctggggggactgggagtgtgagtgtgcatggcatgtgtgtggcacagatggctgggacgggtgacagtgtgagtgcatgtgtgcatgcatgtgtgtatgtgtgtgtgtgtgtggcatgcgctgacaaatgtgtccttgatccacactgctcctggcagagtgagtcacccaaaggccccttcggcctccttgtagctgttttctttccttttgttgttggttttaaaatacattcacacacaaatacaaattgacaggtcaaaatccatgaaatgagatcccccagccgtgtcctccagcccagccctgaccccttggtttctaccctggctccccttggtttctaccctggctcaaccgacccctgtctgcccttctccctcttgcttctgaggtcaagctctggcctgcgagcctgtccccattgcaaaggggagggaggggcagggagctgtctaccagctgaggtcctcccaaaactgggccgatgtggtgtgacatccccaccagcctcagatgagacgggccaggacgcccagccacagcaagccctgtccctttgccggatccccaaacactagagaagctctcctaacccaaggcggagaatgaaggtggtggcggcagaggaggagggcagcagctgagaggccagggacagggtgcctcgccaagctgtctgaggtctgtcccaggtggcccaggtggtgcaggtagaacagggtgaggagagggggtcggctcagcaggaggaggctgtggctgcagagcctgggggagcttttaggtgttgagatggggcagctctgaatcctagaccctggaatagcctgtcccttttctctgggtctcgtggtggagccatgatctgggctgctctcttggggacactgggtggtggttacacagttgacctctgcctggctcccccttggtgcaactcctgcctccatcccccttgctggggtcccctcatccacttgagggcgcctgagggccaggagcagcaggcaaggagcctgggtctaggctaagggggtgtgtgcccacctcctccctgacccttaacactcctgtcctgcccagaccaacagagagagctgtccctgagaccccggagagaagcagctgccgaaagctgcagcctttccgcactctgagaccatgatcttcctcctgccaggggagagccacccacaggccatgtccagccccacttccctcagcccccagggcttccttctggcccctctgaggattccctagggctgccccgcagaggggcttccccaagctctgttttgaagcctgcaatgtggaaaagtgagaagtcagagggaacaggacaggtgcagccgggctctgaggccacacctcacacctcgctgttccccaacatcccctgagcagtgtgagctcatctcaccagatgagaagaggccctgtgcatttcttttgtttgtttgttgctgttttcccccacccatccagttctcctcagcaaagcaaattccttaacacctttggtggagaatttcttacccagacttggggctgtgatgcccttcagtgcgtggtgagtgcagcgtgtgtgcgtgtgcctgtgtgtgaacctgggggccatcctggtggcctgggagcgtgaggagaggccccctgtgtgctgggtgagtggtgggtgtggggtcaatgcagtgaggctctctgggtgaggctcccaacctggcagtccccagcctcccagcatctgtgagcgtctgttggactttacagaagagcctcatcctgtctgcccctcactctgccctggaatcaacatcttccgagtccttcttgggggaaatagcagagccccacttaactccataaactgcttcccattccgcagcccagttctgattgttgaggtgtcgcgtcgttccaggtcccccagtcccctctttctcctgtcctctctctgtccttcacctccccactccagccccggctcagttcagggaaatgctgttccacatcagccctctgctctctgaggcagccgcgcctctgactcggagctacttgaaacttctgctcttgctaggattggagtctacctatctcttccatttgtcccagctggagttctggaactttcctcctcggggtgggggtgggggttgttaaggatgctggggggcctggggaaggaaggagttcagaggaagggtgtcccctgtcctcttgatgtcaccctccgctcctgggacacgtgctctctctgtctctgggtcttctggctgtgcacgtttgtgtgtccttgtaaatatgttttaggaagaaagcaaaagggactgaactagcctctggtaggattgcaggggtccagccttgcctgtttccgaagcccccacactgcctttcgccctactgagactggtcccctcaaaaggtagacaaaacagcagctccctgtggagctgaagggcggcctcaaagtggctttttgttagacaaggttaaggtttcctcatgagcaaggttgcagatcggtccttcctcagctccttgatttgtgaccttgaccaaggggcctgccacccagcccctccagtgccctctcctcgatgcctcgctccttcctgcccccactcccctggcttaggcaggtaggggaattagggccatgctggaagaagcttaaccatgtgttcaaagaacggtttcttgcttgcttggtcctggaactccccttggctgccccaggcctccttggcccatgggtgctgggggaggtggatgtcagatctggtaggttgcagcagagaaaataaatgtgccttgagagaccactcagagagggtccaagggtgatggagaaggaagcatggcctgggagcttggaagggaggggtggtgggtggcggcatcttgactgccccctgttgtcccacacgtggggggtggtcaccccccttcactccagcccgcctgccttcagccttccatgagcttcacctgcttccaacttcactttggagggggtggggtccgttggcatcaacacggggaccctctgcttcaccaaagcccgagccctcagcccctggggagaacaaatggctgagctttgatacctggggtcgtcgagaggctgcgggctggcggcagtcccaggggagagacaccacagaaggagacccagacatcccgaggaagttcccagcagagcaaactgctttccagcctgaagcctgcttaaactgtgtgatgtgcaataactgagcttagagttaggaattgtgttcaagtgcttggatttccgtctgtagatttaactgctgaaattgtatctctcagtaattttagatgtcttttaaaaaattgaaaaacaaagtgttagactgtgtgcgtgtgcgttgatgggcactcaagagtcccgtgagtcatccagccctgcctttcccctgcgcccccatcctctcacgtcccgccccgcctccacttggggaccctgcctcgtgtcgtctttatctgcctattactcagcctaaggaaacaagtacactccacacatgcataaaggaaatcaaatgttatttttaagaaaatggaaaataaaaactttataaacacc

SEQ ID NO: 29582 - DNA, 1284 bp, Homo sapiens
agttgttatacggcttttgtcttaacgaagccacccattacggtatgatgatgtcaaacgtgatgctgatgctacagttacagcccctgctggcgcagcctctctgattctctctccctctccgcgtccagtgctgggctttttcagacaagtgcatctcctaaccaggtcacatttcagccgcgacccactctccgccagtcaccggaggcagaccgcgggaggagagctgaggacagccgcgtgcgcttcgccagcagcggggtgggaggaaggacattaaaatactgcagaagtcaagacccccccaggtcgaacccagaccacgatgcgcgccccgggctgcgggcggctggtgctgccgctgctgctcctggccgcggcagccctggccgaaggcgacgccaaggggctcaaggagggcgagacccccggcaatttcatggaggacgagcaatggctgtcgtccatctcgcagtacagcggcaagatcaagcactggaaccgcttccgagacgttccctcgtccgacccacccagtacaacgcaggccacaccatgacctctcccgttttctccttaaactgcgtgcatccacaagttccttggaaatttgtttaaaacacacatgcttcataggctatccagccaagtgatgggaagaggcagagatttggatctttttgttaccgtcagacaagtgactgtttctccccaaagtcaaactggcaggttgtaattcacagaggacagcaggaaccacgggcagccaggtctccaggctgagtggccgggccccgcgatgggctgctgatctccgccttcgccccacatgcgacctgtccagccgcaggagcctggagccccgcgaggccttcccgaagcacctgcaggcccagcgcagatgagccgcagtctcctgccgcttcctgggcagcagcccggccacagcagcgagggggcggcagcaggccggcccatccggaatccatgtgtcactggcctaggcctccctccgactcgctggctgtttgatctgccaaaatgggaccagtgaaggtcagagggaaaagaaatgcttaatcagaacaggaaaggtttaaaataaaagattcctccccacctcccttcttccacctgcttccaatagccagctccgtgggtgagaataaatgacttactgcttgaccccatggcactgggctacccacctgtctctctgtattggtgccaaccacttcccccttcctctcatgctcatcagaagaaaggcactagatttga

SEQ ID NO: 29583 - DNA, 5000 bp, Homo sapiens
atgcgcgccccgggctgcgggcggctggtgctgccgctgctgctcctggccgcggcagccctggccgaaggcgacgccaaggggctcaaggagggcgagacccccggcaatttcatggaggacgagcaatggctgtcgtccatctcgcagtacagcggcaagatcaagcactggaaccgcttccgagacgggatagaggatgactatatcaagagctgggaggacaatcagcaaggagatgaagccctggataccaccaaggacccctgccagaaggtgaagtgcagccgccacaaggtgtgcattgcccagggctaccagcgggccatgtgcatcagtcgcaagaagctggagcacaggatcaagcagccgaccgtgaaactccatggaaacaaagactccatctgcaagccctgccacatggcccagcttgcctctgtctgcggctcagatggccacacttacagctctgtgtgtaagctggagcaacaggcgtgcctgagcagcaagcagctggcggtgcgatgcgagggcccctgcccctgccccacggagcaggctgccacctccaccgccgatggcaaaccagagacttgcaccggtcaggacctggctgacctgggagatcggctgcgggactggttccagctccttcatgagaactccaagcagaatggctcagccagcagtgtagccggcccggccagcgggctggacaagagcctgggggccagctgcaaggactccattggctggatgttctccaagctggacaccagtgctgacctcttcctggaccagacggagctggccgccatcaacctggacaagtacgaggtctgcatccgtcccttcttcaactcctgtgacacctacaaggatggccgggtctctactgctgagtggtgcttctgcttctggagggagaagcccccctgcctggcagagctggagcgcatccagatccaggaggccgccaagaagaagccaggcatcttcatcccgagctgcgacgaggatggctactaccggaagatgcagtgtgaccagagcagcggtgactgctggtgtgtggaccagctgggcctggagctgactggcacgcgcacgcatgggagccccgactgcgatgacatcgtgggcttctcgggggactttggaagcggtgtcggctgggaggatgaggaggagaaggagacggaggaagcaggcgaggaggccgaggaggaggagggcgaggcaggcgaggctgacgacgggggctacatctggtagacgccctcaggagccggctgccgggggggactcaacagcagagctctgagcagcagcaggcaacttcgagaacggatccagaaatgcagtcagaaggaccctgctccacctggggggactgggagtgtgagtgtgcatggcatgtgtgtggcacagatggctgggacgggtgacagtgtgagtgcatgtgtgcatgcatgtgtgtatgtgtgtgtgtgtgtggcatgcgctgacaaatgtgtccttgatccacactgctcctggcagagtgagtcacccaaaggccccttcggcctccttgtagctgttttctttccttttgttgttggttttaaaatacattcacacacaaatacaaattgacaggtcaaaatccatgaaatgagatcccccagccgtgtcctccagcccagccctgaccccttggtttctaccctggctccccttggtttctaccctggctcaaccgacccctgtctgcccttctccctcttgcttctgaggtcaagctctggcctgcgagcctgtccccattgcaaaggggagggaggggcagggagctgtctaccagctgaggtcctcccaaaactgggccgatgtggtgtgacatccccaccagcctcagatgagacgggccaggacgcccagccacagcaagccctgtccctttgccggatccccaaacactagagaagctctcctaacccaaggcggagaatgaaggtggtggcggcagaggaggagggcagcagctgagaggccagggacagggtgcctcgccaagctgtctgaggtctgtcccaggtggcccaggtggtgcaggtagaacagggtgaggagagggggtcggctcagcaggaggaggctgtggctgcagagcctgggggagcttttaggtgttgagatggggcagctctgaatcctagaccctggaatagcctgtcccttttctctgggtctcgtggtggagccatgatctgggctgctctcttggggacactgggtggtggttacacagttgacctctgcctggctcccccttggtgcaactcctgcctccatcccccttgctggggtcccctcatccacttgagggcgcctgagggccaggagcagcaggcaaggagcctgggtctaggctaagggggtgtgtgcccacctcctccctgacccttaacactcctgtcctgcccagaccaacagagagagctgtccctgagaccccggagagaagcagctgccgaaagctgcagcctttccgcactctgagaccatgatcttcctcctgccaggggagagccacccacaggccatgtccagccccacttccctcagcccccagggcttccttctggcccctctgaggattccctagggctgccccgcagaggggcttccccaagctctgttttgaagcctgcaatgtggaaaagtgagaagtcagagggaacaggacaggtgcagccgggctctgaggccacacctcacacctcgctgttccccaacatcccctgagcagtgtgagctcatctcaccagatgagaagaggccctgtgcatttcttttgtttgtttgttgctgttttcccccacccatccagttctcctcagcaaagcaaattccttaacacctttggtggagaatttcttacccagacttggggctgtgatgcccttcagtgcgtggtgagtgcagcgtgtgtgcgtgtgcctgtgtgtgaacctgggggccatcctggtggcctgggagcgtgaggagaggccccctgtgtgctgggtgagtggtgggtgtggggtcaatgcagtgaggctctctgggtgaggctcccaacctggcagtccccagcctcccagcatctgtgagcgtctgttggactttacagaagagcctcatcctgtctgcccctcactctgccctggaatcaacatcttccgagtccttcttgggggaaatagcagagccccacttaactccataaactgcttcccattccgcagcccagttctgattgttgaggtgtcgcgtcgttccaggtcccccagtcccctctttctcctgtcctctctctgtccttcacctccccactccagccccggctcagttcagggaaatgctgttccacatcagccctctgctctctgaggcagccgcgcctctgactcggagctacttgaaacttctgctcttgctaggattggagtctacctatctcttccatttgtcccagctggagttctggaactttcctcctcggggtgggggtgggggttgttaaggatgctggggggcctggggaaggaaggagttcagaggaagggtgtcccctgtcctcttgatgtcaccctccgctcctgggacacgtgctctctctgtctctgggtcttctggctgtgcacgtttgtgtgtccttgtaaatatgttttaggaagaaagcaaaagggactgaactagcctctggtaggattgcaggggtccagccttgcctgtttccgaagcccccacactgcctttcgccctactgagactggtcccctcaaaaggtagacaaaacagcagctccctgtggagctgaagggcggcctcaaagtggctttttgttagacaaggttaaggtttcctcatgagcaaggttgcagatcggtccttcctcagctccttgatttgtgaccttgaccaaggggcctgccacccagcccctccagtgccctctcctcgatgcctcgctccttcctgcccccactcccctggcttaggcaggtaggggaattagggccatgctggaagaagcttaaccatgtgttcaaagaacggtttcttgcttgcttggtcctggaactccccttggctgccccaggcctccttggcccatgggtgctgggggaggtggatgtcagatctggtaggttgcagcagagaaaataaatgtgccttgagagaccactcagagagggtccaagggtgatggagaaggaagcatggcctgggagcttggaagggaggggtggtgggtggcggcatcttgactgccccctgttgtcccacacgtggggggtggtcaccccccttcactccagcccgcctgccttcagccttccatgagcttcacctgcttccaacttcactttggagggggtggggtccgttggcatcaacacggggaccctctgcttcaccaaagcccgagccctcagcccctggggagaacaaatggctgagctttgatacctggggtcgtcgagaggctgcgggctggcggcagtcccaggggagagacaccacagaaggagacccagacatcccgaggaagttcccagcagagcaaactgctttccagcctgaagcctgcttaaactgtgtgatgtgcaataactgagcttagagttaggaattgtgttcaagtgcttggatttccgtctgtagatttaactgctgaaattgtatctctcagtaattttagatgtcttttaaaaaattgaaaaacaaagtgttagactgtgtgcgtgtgcgttgatgggcactcaagagtcccgtgagtcatccagccctgcctttcccctgcgcccccatcctctcacgtcccgccccgcctccacttggggaccctgcctcgtgtcgtctttatctgcctattactcagcctaaggaaacaagtacactccacacatgcataaaggaaatcaaatgttatttttaagaaaatggaaaataaaaactttataaacacc

SEQ ID NO: 29584 - DNA, 2986 bp, Homo sapiens
gggagcgcgccgggcgcagggagctgagtggacggctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgaagtagaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaaccaaa

SEQ ID NO: 29585 - DNA, 2936 bp, Homo sapiens
gagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaacc

SEQ ID NO: 29586 - DNA, 1749 bp, Homo sapiens
atttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagactaagaagaaaaacgattatttgacaggacagtagtgatgatcacacaagatcacatccacatgtcttctgggctcagtcaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtg

SEQ ID NO: 29587 - DNA, 2180 bp, Homo sapiens
cgcgccgggcgcagggagctgagtggacggctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgaagtagaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcc

SEQ ID NO: 29588 - DNA, 2900 bp, Homo sapiens
tcctctggctccagccaagcgtcctatccggagccaactgtagctgggatccagcgagaggaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaacc

SEQ ID NO: 29589 - DNA, 505 bp, Homo sapiens
gtaaagcctgcggggaggggacacgcttgcctctgcttgtctcctcctccctctaccctcgtcgttgctaatgcatgttttccagggtcgctcctggcttcgtaccccttatttgacactgacatgcccccccaccccccgttgtgtctcctctcccagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgaagtagaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccgga

SEQ ID NO: 29590 - DNA, 2947 bp, Homo sapiens
acaaagcagataaggattcctaggctaggagctacctcgtcctctggctccagccaagcgtcctatccggagccaactgtagctgggatccagcgagaggaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgaagtagaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaac

SEQ ID NO: 29591 - DNA, 556 bp, Homo sapiens
gtgcccgctcgggctgctgcggctggggcttgcttccttatacccacctctcctcctctgggtctgcgtgtgtatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaacta

SEQ ID NO: 29592 - DNA, 563 bp, Homo sapiens
gcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacac

SEQ ID NO: 29593 - DNA, 1963 bp, Homo sapiens
gcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagaggattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcc

SEQ ID NO: 29594 - DNA, 1768 bp, Homo sapiens
gctaatgcatgttttccagggtcgctcctggcttcgtaccccttatttgacactgacatgcccccccaccccccgttgtgtctcctctcccagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaattt

SEQ ID NO: 29595 - DNA, 2908 bp, Homo sapiens
tcctctggctccagccaagcgtcctatccggagccaactgtagctgggatccagcgagaggaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgaagtagaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaac

SEQ ID NO: 29596 - DNA, 505 bp, Homo sapiens; identical to SEQ ID NO: 29589

SEQ ID NO: 29597 - DNA, 1456 bp, Homo sapiens
ctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaaggtaaaagatgagacccttacagacgcaaatagttgacctgcatgtcaaattttacttattttttaagaaaataaaacagtacactatgctcattcattttgtgtatgtttttgtaattcaagtgttgaataaaagagcaaataagaagcatgttgaacaaataactctgccagagatacaacacatgctaaataagatgaaaaatagtaattaatattttgtattaatgccactacattatagtttccattatgagccaccaagaagcacacagaaatattaagaacttagatactgaaagtaatcattaaaattaatttgctatctgctttgcccacaatgtaaaataaatggattttttatcactatacggtggagttttaatgttctattttgtgatcttattaaatgagttgaatgaa

SEQ ID NO: 29598 - DNA, 1457 bp, Homo sapiens
tttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagactgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacct

SEQ ID NO: 29599 - DNA, 1023 bp, Homo sapiens
atgataaacaatggctcaccacaatctctcagtatgacaaggaagtcggacagtggaacaaattccgagacgatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttga

SEQ ID NO: 29600 - DNA, 1398 bp, Homo sapiens
ttttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagaggattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgctt

SEQ ID NO: 29601 - DNA, 1700 bp, Homo sapiens
gtgcccgctcgggctgctgcggctggggcttgcttccttatacccacctctcctcctctgggtctgcgtgtgtatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcagggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgca

SEQ ID NO: 29602 - DNA, 1017 bp, Homo sapiens
atgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagactgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttga

SEQ ID NO: 29603 - DNA, 15324 bp, Homo sapiens
tatcctgagaacttccatgggtcgctggatcagcaggcaaccattatcagactggagagtcatactttaaggaatacaaatgcaacacacgacaatgtttcctgacatcagatgatgaatggacactgaagggaaaaacaggctttttttccacctggcaggaagagctgaacttggagtacacatttaaaggaagcacagagggaagacttaaacagaagaaagaagcgtactttcatggttttcacaaacaaatatcccaggagaagtgatcatggagaccaaggagaacaggtgggtcccggtgaccgtgctccccggctgcgtgggctgcaggaccgtcgcggcgctggcgtcctggaccgtgcgcgatgtgaaggaacgtatcttcgcggagactggcttcccggtgtcggagcagcggctgtggcgcggcggccgcgagttatctgactggatcaagattggagatctgacttccaaaaattgtcatctttttgtaaaccttcaatcaaaaggcttaaaagggggaggtcgatttggtcagacaacgccaccacttgttgattttctcaaggacattttgagaagatatccagaaggaggacagattcttaaggaattaattcagaatgcagaagatgctggggcgacagaagttaaatttttatatgatgaaactcaatacggaacagagactctttggtcaaaagatatggcgccatatcaggggccagctctctatgtgtacaacaacgcggttttcaccccagaggactggcacggcattcaagaaatagcaagaagcaggaaaaaggatgatcctctgaaggtcggaagatttggaattgggtttaattctgtctatcatataacagatgttccttgtatctttagtggtgaccaaatcgggatgctagatcctcatcaaacactttttggcccacatgaatcaggccaatgttggaatctcaaagatgacagcaaagaaattagtgaactttcagaccagtttgcaccatttgttggcatttttggaagcaccaaggaaacatttataaacggcaattttccaggaacatttttccgtttccctcttcgcctacaaccttcacaacttagtagtaacctctacaataagcagaaggttcttgagttgtttgagtcttttagggcagatgcagacacagtgctgctctttctgaaaagtgtgcaggatgtttccttatatgtccgagaggctgacggaacagagaaactggtgtttagagtgacttcgagtgagagtaaggcactgaaacatgagcggccgaattctataaagattctgggaactgctataagtaactattgtaaaaagactccaagcaataacatcacctgtgtaacatatcacgtaaatattgttttagaagaggagagtactaaggatgcacagaaaacatcttggttggtgtgtaacagtgtgggtgggcgagggatcagtagtaagcttgactctttagctgatgaactgaaatttgtcccaatcattggaatagccatgcctttatcaagcagagatgatgaagcaaaaggagcaacgtctgatttctcaggaaaagcattttgtttccttcctttaccacctggtgaggaaagcagcacaggcctcccagttcacatcagtgggttctttggccttactgataaccgcaggagcataaaatggagagagctggaccagtggagagacccggcagccttatggaatgagtttcttgtcatgaatgttgtccccaaagcttatgctactctgatcttagattcaataaaacgtctggagatggaaaagagctctgatttccccttgtcagttgatgttatctataagctttggccggaggcgagcaaagtcaaggtgcactggcaaccggtgttagagcctctattcagcgagctgttgcagaatgcagtgatttattcaattagctgtgactgggtcaggttggagcaggtgtacttctcagaacttgatgaaaatttagaatacacaaaaactgtgctcaactacctccagagctcagggaagcagattgccaaggtaccagggaatgtggatgctgctgttcagctcacagctgcctctggcacaacacctgtgaggaaggtgacgcccgcgtgggtgcggcaggtgctgcggaagtgtgcacacctgggctgtgctgaagaaaagcttcaccttctagaatttgtgctttctgaccaagcctacagtgagctgcttgggctggagctgctccctttacaaaatggcaattttgtccccttctcctcatctgtatcagaccaagatgtcatttatattacctcagcagaatatccaaggtcccttttcccaagtcttgaaggaagatttattttggataacttgaaacctcaccttgtggctgctttaaaggaagctgcccaaacccgaggaagaccatgtactcagctgcagcttctaaatccagaacgatttgcacgtcttatcaaggaagtaatgaatacattctggcctggcagagaattgattgttcaatggtatccatttgatgaaaacagaaatcacccatctgtttcatggcttaagatggtttggaaaaatctttatatacatttttcagaggatttgactttatttgatgagatgccacttatccccagaactatactagaggaaggtcagacatgtgtggaactcattagactcaggattccatcgttagtcattttagacgatgaatctgaagcacagcttccagaatttttagcagacattgtacaaaaacttggagggtttgtccttaaaaaattagatgcatctatacaacatccgcttattaaaaaatatattcattcaccattaccaagtgctgttttgcagataatggagaagatgccattgcagaaattgtgtaatcaaataacttcgctacttccaacacacaaagatgccctgaggaagttcttggctagtttaaccgatagcagtgagaaagagaaaagaattattcaagaattggcaatattcaagcgcattaaccattcttctgatcagggaatttcctcttatacaaaattgaaaggttgtaaagtcttacaccatactgccaaactcccagcagatctgcgactttctatttcagtaatagacagtagtgatgaagctactattcgtctggcaaacatgttgaaaatagaacagttaaagaccactagctgcttaaagcttgttttaaaagatattgaaaatgcattttattcacatgaagaggtaacacagcttatgttatgggtccttgagaatctatcttctcttaaaaatgagaatccaaatgtgcttgagtggttaacaccattaaaattcatccagatatcacaggaacagatggtatcagctggtgaactctttgaccctgatatagaagtactaaaggatctcttttgtaatgaagaaggaacctatttcccaccctcagtttttacctcaccagatattcttcactccttaagacagattggtttaaaaaacgaagccagtctcaaagaaaaggatgttgtgcaagtggcaaaaaaaattgaagccttacaggtcggtgcttgtcctgatcaagatgttcttctgaagaaagccaaaaccctcttactggttttaaataagaatcacacactgttgcaatcatctgaaggaaagatgacattgaagaaaataaaatgggttccagcctgcaaggaaaggcctccaaattatccaggctctttggtctggaaaggagatctctgtaatctctgtgcaccaccagatatgtgtgatgtaggccatgcaattctcattggctcctcacttcctcttgttgaaagtatccatgtaaacctggaaaaagcattagggatcttcacaaaacctagccttagtgctgtcttaaaacactttaaaattgttgttgattggtattcttcaaaaacctttagtgatgaagactactatcaattccagcatattttgcttgagatttacggattcatgcatgatcatctaaatgaagggaaagattcttttagagccttaaaatttccatgggtttggactggcaaaaagttttgtccacttgcccaggctgtgattaaaccaatccatgatcttgaccttcagccttatttgcataatgtacctaaaaccatggcaaaattccaccaactatttaaggtctgtggttcaatagaggagttgacatcagatcatatttccatggttattcagaagatatatctcaaaagtgaccaagatctcagtgaacaagaaagcaaacaaaatcttcatcttatgttgaatattatcagatggctgtatagcaatcagattccagcaagccccaacacaccagttcctatacatcatagcaaaaatccttctaaacttatcatgaagccaattcacgaatgctgttattgtgacattaaagttgatgaccttaatgacttacttgaagattctgtggaaccaatcattttggtgcatgaggacatacccatgaaaactgcagaatggctaaaagttccatgccttagtacaagactgataaatcctgaaaacatgggatttgagcagtcaggacaaagagagccacttactgtaagaattaaaaatattctggaagaatacccttcagtgtcagatatttttaaagaactacttcaaaacgctgatgatgcaaatgcaacagaatgcagtttcttgattgatatgagaagaaatatggacataagagagaatctcctagacccagggatggcagcttgtcatggacctgctttgtggtcattcaacaattctcaattctcagattcagattttgtgaacataactaggttaggagaatctttaaaaaggggagaagttgacaaagttggaaaatttggtcttggatttaattctgtgtaccatatcactgacattcccatcattatgagtcgggaattcatgataatgttcgatccaaacataaatcatatcagtaaacacattaaagacaaatccaatcctgggatcaaaattaattggagtaaacaacagaaaagacttagaaaatttcctaatcagttcaaaccatttatagatgtatttggctgtcagttacctttgactgtagaagcaccttacagctataatggaacccttttccgactgtcctttagaactcaacaggaagcaaaagtgagtgaagttagtagtacgtgctacaatacagcagatatttattctcttgtggatgaatttagtctctgtggacacaggcttatcattttcactcagagtgtaaagtcaatgtatttgaagtacttgaaaattgaggaaaccaaccccagtttagcacaagatacagtaataattaaaaaaaaatcctgctcttccaaagcattgaacacacctgtcttaagtgttttaaaagaggctgctaagctcatgaagacttgcagcagcagtaataaaaagcttcccagtgatgaaccaaagtcatcttgcattcttcagatcacagtggaagaatttcaccatgtgttcagaaggattgctgatttacagtcgccactttttagaggtccagatgatgacccagctgctctctttgaaatggctaagtctggccaatcaaaaaagccatcagatgagttgtcacagaaaacagtagagtgtaccacgtggcttctgtgtacttgcatggacacaggagaggctctgaagttttccctgagtgagagtggaagaagactaggactggttccatgtggggcagtaggagttcagctgtcagaaatccaggaccagaagtggacagtgaaaccacacattggagaggtgttttgctatttacctttacgaataaaaacaggcttgccagttcatatcaatgggtgctttgctgttacatcaaataggaaagaaatctggaaaacagatacaaaaggacgatggaataccacgttcatgagacatgttattgtgaaagcttacttacaggtactgagtgtcttacgggacctggccactagtggggagctaatggattatacttactatgcagtatggcccgatcctgatttagttcatgatgatttttctgtaatttgccaaggattttatgaagatatagctcatggaaaagggaaagaactgaccaaagtcttctctgatggatctacttgggtttccatgaagaacgtaagatttctagatgactctatacttaaaagaagagatgttggttcagcagccttcaagatatttttgaaatacctcaagaagactgggtccaaaaacctttgtgctgttgaacttccttcttcggtaaaattaggatttgaagaagctggctgcaaacagatactacttgaaaacacattttcagagaaacagtttttttctgaagtgttttttccaaatattcaagaaattgaagcagaacttagagatcctttaatgatctttgttctaaatgaaaaagttgatgagttctcgggagttcttcgtgttactccatgtattccttgttccttggaggggcatcctttggttttgccatcaagattgatccaccccgaaggacgagttgcaaagttatttgatattaaagatgggagattcccttatggttctactcaggattatctcaatcctattattttgattaaactagttcagttaggtatggcaaaagatgatattttatgggatgatatgctagaacgtgcagtgtcagtagctgaaattaataaaagtgatcatgttgctgcatgcctaagaagtagtatcttattgagtcttatcgatgagaaactaaaaataagggatcctagagcaaaggattttgctgcaaaatatcaaacaatccgcttccttccatttctgacaaaaccagcaggtttttctttggactggaaaggcaacagttttaagcctgaaaccatgtttgcagcaactgacctttatacagctgaacatcaagatatagtttgtcttttgcaaccaattctaaatgaaaattcccattcttttagaggttgtggttcagtgtcattggctgttaaagagtttttgggattactcaagaagccaacagttgatctggttataaaccaattgaaagaagtagcaaaatcagttgatgatggaattacactgtaccaggagaatatcaccaatgcttgctacaaataccttcatgaagccttgatgcaaaatgaaatcactaagatgtcaattattgataagttaaaaccctttagcttcattctagttgagaatgcatatgttgactcagaaaaggtttcttttcatttaaattttgaggcggcaccatacctttatcagttgcctaataagtataaaaataatttccgcgaactttttgaaaccgtgggtgtgaggcagtcatgcactgttgaagattttgctcttgttttggaatctattgatcaagaaagaggaacaaagcaaataacagaagagaattttcagctttgccgacgaataatcagtgaaggaatatggagtctcattagagaaaagaaacaagaattttgtgagaaaaattatggcaagatattattgccagatactaatcttatgcttctccctgctaaatcgttatgctacaatgattgcccttggataaaagtaaaggataccactgtaaaatattgtcatgctgacatacccagggaagtagcagtaaaactaggagcagtcccaaagcgacacaaagccttagaaagatatgcatccaatgtctgttttacaacacttggcacagaatttgggcagaaagaaaaattgaccagcagaattaagagcatccttaatgcatatccttctgaaaaggaaatgttgaaagagcttcttcaaaatgctgatgatgcaaaggcgacagaaatctgttttgtgtttgatcctagacagcatccagttgatagaatatttgatgataagtgggccccattgcaagggccagcactttgtgtgtacaacaaccagccatttacagaagatgatgttagaggaattcagaatcttggaaaaggcacgaaagagggaaatccttataaaactggacagtatggaataggattcaattctgtgtatcatatcacagactgcccatcttttatttctggcaatgacatcctgtgtatttttgatcctcatgccagatatgcaccaggggccacatccattagtcccggacgcatgtttagagatttggatgcagattttaggacacagttctcagatgttctggatctttatctgggaacccattttaaactggataattgcacaatgttcagatttcctcttcgtaatgcagaaatggcaaaagtttcggaaatttcgtctgttccagcatcagacagaatggtccagaatcttttggacaaactgcgctcagatggggcagaacttctaatgtttcttaatcacatggaaaaaatttctatttgtgaaatagataagagtactggagctctaaatgtgctgtattcagtaaagggcaaaatcacagatggagacagattgaaaaggaaacaatttcatgcatctgtaattgatagtgttactaaaaagaggcagctcaaagacataccagttcaacaaataacctatactatggatactgaggactctgaaggaaatcttactacgtggctaatttgtaatagatcaggcttttcaagtatggagaaagtatctaaaagtgtcatatcagctcacaagaaccaagatattactcttttcccacgtggtggagtagctgcctgcattactcacaactataaaaaaccccatagggccttctgttttttgcctctttctttggagactgggctgccatttcatgtgaatggccactttgcactggattcagccagaaggaacctgtggcgtgatgataatggagttggtgttcgaagtgactggaataacagtttaatgacagcattaatagctcctgcatatgttgaattgctaatacagttaaaaaaacggtatttccctggttctgatccaacattatcagtgttacagaacacccctattcatgttgtaaaggacactttaaagaagtttttatcgtttttcccagttaaccgtcttgatctacagccagatttatattgtctagtgaaagcactttacaattgcattcacgaagacatgaaacgtcttttacctgttgtgcgggctccaaatattgatggctctgacttgcactctgcagttataattacttggatcaatatgtctacttctaataaaactagaccattttttgacaatttactacaggatgaattacaacaccttaaaaatgcagattataatatcaccacacgcaaaacagtagcagagaatgtctataggctgaaacatctccttttagaaattggtttcaacttggtttataactgtgatgaaactgctaatctttaccactgtcttatagatgcagatattcctgttagttatgtgacccctgctgatatcagatcttttttaatgacattttcctctcctgacactaattgccatattgggaagctgccttgtcgtctgcagcagactaatctaaaactttttcatagtttaaaacttttagttgattattgttttaaagatgcagaagaaaatgagattgaagttgagggattgccccttctcatcacactggacagtgttttgcaaacttttgatgcaaaacgacccaagtttctaacaacatatcatgaattgattccatcccgcaaagacttgtttatgaatacattatatttgaaatatagtaatattttattgaactgtaaagttgcaaaagtgtttgacatttccagctttgctgatttgttatcctctgtgttgcctcgagaatataagaccaaaagttgcacaaagtggaaagacaattttgcaagtgagtcttggcttaagaatgcatggcattttattagtgaatctgtaagtgtgaaagaagatcaggaagaaacaaaaccaacatttgacattgttgttgatactctaaaagactgggcattgcttccaggaacaaagtttactgtttcagccaaccagcttgtggttcctgaaggagatgttctgcttcctctcagccttatgcacattgcagtttttccaaatgcccagagtgataaagtttttcatgctctaatgaaagctggctgtattcagcttgctttgaacaaaatctgttccaaagacagtgcatttgttcctttgttgtcatgtcacacagcaaatatagagagccccacaagcatcttgaaggctctacattatatggtccaaacttcaacatttagagcagaaaaattagtagaaaatgattttgaggcacttttgatgtatttcaactgcaatttgaatcatttgatgtcccaagatgatataaaaattctaaagtcacttccgtgctataaatccatcagtggccgctatgtaagcattggaaaatttggaacatgctacgtacttacaaaaagtatcccttcagctgaagtggagaaatggacacagtcatcatcatctgcatttcttgaagaaaaaatacacttaaaagaactatatgaggtgattggttgtgtacctgtagatgatcttgaggtatatttgaaacacctcttaccaaaaattgaaaatctctcttatgatgcaaaattagagcacttgatctaccttaagaatagattatcaagtgctgaggaattatcagagattaaggaacaactttttgaaaaactggaaagtttattgataatccatgatgctaacagtagactaaagcaagcaaagcatttctatgatagaactgtgagagtttttgaagttatgcttcctgaaaaattgtttattcctaatgatttctttaagaaattggaacaacttataaaacccaaaaatcatgttacatttatgacatcctgggtggaattcttaagaaatattggactaaaatacatactttctcagcagcagttgttacagtttgctaaggaaatcagtgtgagggctaatacagaaaactggtccaaagaaacattgcaaaatacagttgatatccttctgcatcatatattccaagaacgaatggatttgttatctggaaattttctgaaagaactatctttaataccattcttatgtcctgagcgggcccccgcggaattcattagatttcatcctcaatatcaagaggtaaatggaacacttcctcttataaagttcaatggagcacaggtaaatccaaaattcaagcaatgtgatgtactccagctgttatggacatcctgccctattcttccagagaaagctacacccttaagcattaaagaacaagaaggtagtgaccttggtccacaagaacagcttgaacaagttttaaatatgcttaatgttaacctggatcctcctcttgataaggtaatcaataactgcagaaacatatgcaacataacgacgttggatgaagaaatggtaaaaactagagcaaaagtcttaaggagcatatatgaattcctcagtgcagaaaaaagggaatttcgttttcagttgcgaggggttgcttttgtgatggtagaagatggttggaaacttctgaagcctgaggaggtagtcataaacctagaatatgaatctgattttaaaccttatttgtacaagctacctttagaacttggcacatttcaccagttgttcaaacacttaggtactgaagatattatttcaactaagcaatatgttgaagtgttgagccgcatatttaaaaattctgagggcaaacaattagatcctaatgaaatgcgtacagttaagagagtagtttctggtctgttcaggagtctacagaatgattcagtcaaggtgaggagtgatctcgagaatgtacgagaccttgcgctttacctcccaagccaggatggtagattggtaaagtcaagcatcttagtgtttgacgatgcgccacattataaaagtagaatccaggggaatattggtgtgcaaatgttagttgatctcagccagtgctacttagggaaagaccatggatttcacactaagttgataatgctctttcctcaaaaacttagacctcgattattgagcagtatacttgaagaacaattagatgaagagactcccaaagtttgtcagtttggagcgttgtgttctcttcaaggaagattgcagttactcttgtcttctgaacagttcattacaggactgattagaattatgaagcatgaaaatgataatgcttttctggccaatgaagaaaaagccataagactttgcaaagccctaagagaaggattgaaagtatcctgctttgaaaagcttcaaacaacattaagagttaaaggttttaatcctattccccacagcagaagtgaaacttttgcttttttgaagcgatttggtaatgcagtcatcttgctctacattcaacattcagacagtaaagacattaatttcctgttagcattggcaatgactcttaaatcagcaactgacaatttgatttctgacacttcatatttaattgctatgctaggatgcaatgatatttacaggattggtgagaaacttgacagtttaggagtgaaatatgactcttcggagccatcaaaactggaacttccaatgcctggcacaccaattcctgctgaaattcattacactctgcttatggacccaatgaatgttttttacccgggagaatatgttgggtaccttgttgatgctgaaggtggtgatatctatggatcataccagccaacatacacatatgcaattattgtacaagaagttgaaagagaagatgctgacaattctagttttctaggaaagatatatcagatagatattggttatagtgaatataaaatagttagctctcttgatctgtataagttttcaagacctgaggaaagctctcaaagcagggacagtgctccttctacaccaaccagccccactgagttcctcacccctggcctgagaagcattcctcctcttttctctggtagagagagccacaagacttcttccaaacatcagtcccccaaaaagcttaaggttaattctttaccagaaatcttaaaagaagtgacatctgtggtggagcaagcatggaagcttccagaatcggaacgaaaaaagattattaggcggttgtatttgaaatggcatcctgacaaaaatccagagaaccatgacattgccaatgaagtttttaaacatttgcagaatgaaatcaacagattagaaaaacaggcttttctagatcaaaatgcagacagggcctccagacgaacattttcaacctcagcatcccgatttcagtcagacaaatactcatttcagagattctatacttcatggaatcaagaagcaacgagccataaatctgaaagacagcaacagaacaaagaaaaatgccccccttcagccggacagacttactctcaaaggttctttgttcctcccactttcaagtcggttggcaatccagtggaagcacgcagatggctaagacaagccagagcaaacttctcagctgccaggaatgaccttcataaaaatgccaatgagtgggtgtgctttaaatgttacctttctaccaagttagctttgattgcagctgactatgctgtgaggggaaagtctgataaagatgtaaaaccaactgcacttgctcagaaaatagaggaatatagtcagcaacttgaaggactgacaaatgatgttcacacattggaagcttatggtgtagacagtttaaaaacaagataccctgatttgcttccctttcctcagatcccaaatgacaggttcacttctgaggttgctatgagggtgatggaatgtactgcctgtatcataataaaacttgaaaattttatgcaacaaaaagtgtgaagatatttaacgaaaaaaaaggtagatcttgaatgtgttgtagcacgaataaattgctgtacttcattaagcttcattgccaattagctaggaattgttaagcacattgcagattgttcttggagaattctggagttgttatgaacatgaataccaacggaaaaccttaactgaatctaaaagaaaactattttgaagatggtggtgagctgcaaaatagctggatggatttgaatgattgggatgatacatcattgaactgcactttatataaccaaagcttagcagtttgttagataagagtctatgtatgtctctggttaggatgaagttaattttatgtttttaacatggtatttttgaaggagctaatgaaacactggacatataattggtttaaacataaggggaattaagtctttgtagtctgtcatttttttaagtggatcctcttggatgcgttattttctcatcagctggctctgatcatgaatttgttgtaattttatgttgtactcagtgcatttaagaaatggtagagtattttaatcctattacttgactaagagtgtgaaggtagtactttttagagtgcactgagtgcactttacatctttatttaaatttttttttaacatcttatgtttacaggcttcctgtttgatgaagatagcaacggaaaactcaaaatggtggcagttcttattaccagttgttagtattgtttctggaaactgcttgccaagacaacatttattaactgttagaacacttgctttatgtttgtgtgtacatattttccacaaatgttataatttatatagtgtggttgaacaggatgcaatcttttgttgtctaaaggtgctgcagttaaaaaaaaaacaaccttttctttcaatatggcatgtagtggagtttttttaactttaaaaacatcaaaaattgttaaaatcattgtgttatctagtagtttataattatcggcttatatttccccatgaatgatcagaactgacatttaattcatgtttgtctcgccatgcttctttactttaacatatttcttttgcagaatgtaaaaggtaatgataattagtttatataagtgtactggctgtaaatgatgctaaatatactttatgcaattaagggcttacagaacatgttgaaactttttttacttttattgggaataaggaatgtttgcacctccacattttattgcttctggatgtgaaatcatgtaattatttctgctgttatataaagtgccatacttttaataaaggaaaatgtacatatgaaatcat

SEQ ID NO: 29604 - DNA, 15639 bp, Homo sapiens
agtgcggctgcgggacagtcacgctgggaactgctgatggcactggaggaaaacaaaggccgagagaccctgatgcccacagcccccagatcacagaagtgaggccaagatgcccatgtcaccagagccagaagaaaggctcctaccaaagaatattttacatctgctgagatgagggtgagaaacaaaatccaagaatttctgcgacgttttccccaagaaccttcaaaaagaaatacagaaaattctcagatgaaaataaattgattttgctctgggggaaagccaaaaacctttagcgaatccacactgttttatcctgagaacttccatgggtcgctggatcagcaggcaaccattatcagactggagagtcatactttaaggaatacaaatgcaacacacgacaatgtttcctgacatcagatgatgaatggacactgaagggaaaaacaggctttttttccacctggcaggaagagctgaacttggagtacacatttaaaggaagcacagagggaagacttaaacagaagaaagaagcgtactttcatggttttcacaaacaaatatcccaggagaagtgatcatggagaccaaggagaacaggtgggtcccggtgaccgtgctccccggctgcgtgggctgcaggaccgtcgcggcgctggcgtcctggaccgtgcgcgatgtgaaggaacgtatcttcgcggagactggcttcccggtgtcggagcagcggctgtggcgcggcggccgcgagttatctgactggatcaagattggagatctgacttccaaaaattgtcatctttttgtaaaccttcaatcaaaaggcttaaaagggggaggtcgatttggtcagacaacgccaccacttgttgattttctcaaggacattttgagaagatatccagaaggaggacagattcttaaggaattaattcagaatgcagaagatgctggggcgacagaagttaaatttttatatgatgaaactcaatacggaacagagactctttggtcaaaagatatggcgccatatcaggggccagctctctatgtgtacaacaacgcggttttcaccccagaggactggcacggcattcaagaaatagcaagaagcaggaaaaaggatgatcctctgaaggtcggaagatttggaattgggtttaattctgtctatcatataacagatgttccttgtatctttagtggtgaccaaatcgggatgctagatcctcatcaaacactttttggcccacatgaatcaggccaatgttggaatctcaaagatgacagcaaagaaattagtgaactttcagaccagtttgcaccatttgttggcatttttggaagcaccaaggaaacatttataaacggcaattttccaggaacatttttccgtttccctcttcgcctacaaccttcacaacttagtagtaacctctacaataagcagaaggttcttgagttgtttgagtcttttagggcagatgcagacacagtgctgctctttctgaaaagtgtgcaggatgtttccttatatgtccgagaggctgacggaacagagaaactggtgtttagagtgacttcgagtgagagtaaggcactgaaacatgagcggccgaattctataaagattctgggaactgctataagtaactattgtaaaaagactccaagcaataacatcacctgtgtaacatatcacgtaaatattgttttagaagaggagagtactaaggatgcacagaaaacatcttggttggtgtgtaacagtgtgggtgggcgagggatcagtagtaagcttgactctttagctgatgaactgaaatttgtcccaatcattggaatagccatgcctttatcaagcagagatgatgaagcaaaaggagcaacgtctgatttctcaggaaaagcattttgtttccttcctttaccacctggtgaggaaagcagcacaggcctcccagttcacatcagtgggttctttggccttactgataaccgcaggagcataaaatggagagagctggaccagtggagagacccggcagccttatggaatgagtttcttgtcatgaatgttgtccccaaagcttatgctactctgatcttagattcaataaaacgtctggagatggaaaagagctctgatttccccttgtcagttgatgttatctataagctttggccggaggcgagcaaagtcaaggtgcactggcaaccggtgttagagcctctattcagcgagctgttgcagaatgcagtgatttattcaattagctgtgactgggtcaggttggagcaggtgtacttctcagaacttgatgaaaatttagaatacacaaaaactgtgctcaactacctccagagctcagggaagcagattgccaaggtaccagggaatgtggatgctgctgttcagctcacagctgcctctggcacaacacctgtgaggaaggtgacgcccgcgtgggtgcggcaggtgctgcggaagtgtgcacacctgggctgtgctgaagaaaagcttcaccttctagaatttgtgctttctgaccaagcctacagtgagctgcttgggctggagctgctccctttacaaaatggcaattttgtccccttctcctcatctgtatcagaccaagatgtcatttatattacctcagcagaatatccaaggtcccttttcccaagtcttgaaggaagatttattttggataacttgaaacctcaccttgtggctgctttaaaggaagctgcccaaacccgaggaagaccatgtactcagctgcagcttctaaatccagaacgatttgcacgtcttatcaaggaagtaatgaatacattctggcctggcagagaattgattgttcaatggtatccatttgatgaaaacagaaatcacccatctgtttcatggcttaagatggtttggaaaaatctttatatacatttttcagaggatttgactttatttgatgagatgccacttatccccagaactatactagaggaaggtcagacatgtgtggaactcattagactcaggattccatcgttagtcattttagacgatgaatctgaagcacagcttccagaatttttagcagacattgtacaaaaacttggagggtttgtccttaaaaaattagatgcatctatacaacatccgcttattaaaaaatatattcattcaccattaccaagtgctgttttgcagataatggagaagatgccattgcagaaattgtgtaatcaaataacttcgctacttccaacacacaaagatgccctgaggaagttcttggctagtttaaccgatagcagtgagaaagagaaaagaattattcaagaattggcaatattcaagcgcattaaccattcttctgatcagggaatttcctcttatacaaaattgaaaggttgtaaagtcttacaccatactgccaaactcccagcagatctgcgactttctatttcagtaatagacagtagtgatgaagctactattcgtctggcaaacatgttgaaaatagaacagttaaagaccactagctgcttaaagcttgttttaaaagatattgaaaatgcattttattcacatgaagaggtaacacagcttatgttatgggtccttgagaatctatcttctcttaaaaatgagaatccaaatgtgcttgagtggttaacaccattaaaattcatccagatatcacaggaacagatggtatcagctggtgaactctttgaccctgatatagaagtactaaaggatctcttttgtaatgaagaaggaacctatttcccaccctcagtttttacctcaccagatattcttcactccttaagacagattggtttaaaaaacgaagccagtctcaaagaaaaggatgttgtgcaagtggcaaaaaaaattgaagccttacaggtcggtgcttgtcctgatcaagatgttcttctgaagaaagccaaaaccctcttactggttttaaataagaatcacacactgttgcaatcatctgaaggaaagatgacattgaagaaaataaaatgggttccagcctgcaaggaaaggcctccaaattatccaggctctttggtctggaaaggagatctctgtaatctctgtgcaccaccagatatgtgtgatgtaggccatgcaattctcattggctcctcacttcctcttgttgaaagtatccatgtaaacctggaaaaagcattagggatcttcacaaaacctagccttagtgctgtcttaaaacactttaaaattgttgttgattggtattcttcaaaaacctttagtgatgaagactactatcaattccagcatattttgcttgagatttacggattcatgcatgatcatctaaatgaagggaaagattcttttagagccttaaaatttccatgggtttggactggcaaaaagttttgtccacttgcccaggctgtgattaaaccaatccatgatcttgaccttcagccttatttgcataatgtacctaaaaccatggcaaaattccaccaactatttaaggtctgtggttcaatagaggagttgacatcagatcatatttccatggttattcagaagatatatctcaaaagtgaccaagatctcagtgaacaagaaagcaaacaaaatcttcatcttatgttgaatattatcagatggctgtatagcaatcagattccagcaagccccaacacaccagttcctatacatcatagcaaaaatccttctaaacttatcatgaagccaattcacgaatgctgttattgtgacattaaagttgatgaccttaatgacttacttgaagattctgtggaaccaatcattttggtgcatgaggacatacccatgaaaactgcagaatggctaaaagttccatgccttagtacaagactgataaatcctgaaaacatgggatttgagcagtcaggacaaagagagccacttactgtaagaattaaaaatattctggaagaatacccttcagtgtcagatatttttaaagaactacttcaaaacgctgatgatgcaaatgcaacagaatgcagtttcttgattgatatgagaagaaatatggacataagagagaatctcctagacccagggatggcagcttgtcatggacctgctttgtggtcattcaacaattctcaattctcagattcagattttgtgaacataactaggttaggagaatctttaaaaaggggagaagttgacaaagttggaaaatttggtcttggatttaattctgtgtaccatatcactgacattcccatcattatgagtcgggaattcatgataatgttcgatccaaacataaatcatatcagtaaacacattaaagacaaatccaatcctgggatcaaaattaattggagtaaacaacagaaaagacttagaaaatttcctaatcagttcaaaccatttatagatgtatttggctgtcagttacctttgactgtagaagcaccttacagctataatggaacccttttccgactgtcctttagaactcaacaggaagcaaaagtgagtgaagttagtagtacgtgctacaatacagcagatatttattctcttgtggatgaatttagtctctgtggacacaggcttatcattttcactcagagtgtaaagtcaatgtatttgaagtacttgaaaattgaggaaaccaaccccagtttagcacaagatacagtaataattaaaaaaaaatcctgctcttccaaagcattgaacacacctgtcttaagtgttttaaaagaggctgctaagctcatgaagacttgcagcagcagtaataaaaagcttcccagtgatgaaccaaagtcatcttgcattcttcagatcacagtggaagaatttcaccatgtgttcagaaggattgctgatttacagtcgccactttttagaggtccagatgatgacccagctgctctctttgaaatggctaagtctggccaatcaaaaaagccatcagatgagttgtcacagaaaacagtagagtgtaccacgtggcttctgtgtacttgcatggacacaggagaggctctgaagttttccctgagtgagagtggaagaagactaggactggttccatgtggggcagtaggagttcagctgtcagaaatccaggaccagaagtggacagtgaaaccacacattggagaggtgttttgctatttacctttacgaataaaaacaggcttgccagttcatatcaatgggtgctttgctgttacatcaaataggaaagaaatctggaaaacagatacaaaaggacgatggaataccacgttcatgagacatgttattgtgaaagcttacttacaggtactgagtgtcttacgggacctggccactagtggggagctaatggattatacttactatgcagtatggcccgatcctgatttagttcatgatgatttttctgtaatttgccaaggattttatgaagatatagctcatggaaaagggaaagaactgaccaaagtcttctctgatggatctacttgggtttccatgaagaacgtaagatttctagatgactctatacttaaaagaagagatgttggttcagcagccttcaagatatttttgaaatacctcaagaagactgggtccaaaaacctttgtgctgttgaacttccttcttcggtaaaattaggatttgaagaagctggctgcaaacagatactacttgaaaacacattttcagagaaacagtttttttctgaagtgttttttccaaatattcaagaaattgaagcagaacttagagatcctttaatgatctttgttctaaatgaaaaagttgatgagttctcgggagttcttcgtgttactccatgtattccttgttccttggaggggcatcctttggttttgccatcaagattgatccaccccgaaggacgagttgcaaagttatttgatattaaagatgggagattcccttatggttctactcaggattatctcaatcctattattttgattaaactagttcagttaggtatggcaaaagatgatattttatgggatgatatgctagaacgtgcagtgtcagtagctgaaattaataaaagtgatcatgttgctgcatgcctaagaagtagtatcttattgagtcttatcgatgagaaactaaaaataagggatcctagagcaaaggattttgctgcaaaatatcaaacaatccgcttccttccatttctgacaaaaccagcaggtttttctttggactggaaaggcaacagttttaagcctgaaaccatgtttgcagcaactgacctttatacagctgaacatcaagatatagtttgtcttttgcaaccaattctaaatgaaaattcccattcttttagaggttgtggttcagtgtcattggctgttaaagagtttttgggattactcaagaagccaacagttgatctggttataaaccaattgaaagaagtagcaaaatcagttgatgatggaattacactgtaccaggagaatatcaccaatgcttgctacaaataccttcatgaagccttgatgcaaaatgaaatcactaagatgtcaattattgataagttaaaaccctttagcttcattctagttgagaatgcatatgttgactcagaaaaggtttcttttcatttaaattttgaggcggcaccatacctttatcagttgcctaataagtataaaaataatttccgcgaactttttgaaaccgtgggtgtgaggcagtcatgcactgttgaagattttgctcttgttttggaatctattgatcaagaaagaggaacaaagcaaataacagaagagaattttcagctttgccgacgaataatcagtgaaggaatatggagtctcattagagaaaagaaacaagaattttgtgagaaaaattatggcaagatattattgccagatactaatcttatgcttctccctgctaaatcgttatgctacaatgattgcccttggataaaagtaaaggataccactgtaaaatattgtcatgctgacatacccagggaagtagcagtaaaactaggagcagtcccaaagcgacacaaagccttagaaagatatgcatccaatgtctgttttacaacacttggcacagaatttgggcagaaagaaaaattgaccagcagaattaagagcatccttaatgcatatccttctgaaaaggaaatgttgaaagagcttcttcaaaatgctgatgatgcaaaggcgacagaaatctgttttgtgtttgatcctagacagcatccagttgatagaatatttgatgataagtgggccccattgcaagggccagcactttgtgtgtacaacaaccagccatttacagaagatgatgttagaggaattcagaatcttggaaaaggcacgaaagagggaaatccttataaaactggacagtatggaataggattcaattctgtgtatcatatcacagactgcccatcttttatttctggcaatgacatcctgtgtatttttgatcctcatgccagatatgcaccaggggccacatccattagtcccggacgcatgtttagagatttggatgcagattttaggacacagttctcagatgttctggatctttatctgggaacccattttaaactggataattgcacaatgttcagatttcctcttcgtaatgcagaaatggcaaaagtttcggaaatttcgtctgttccagcatcagacagaatggtccagaatcttttggacaaactgcgctcagatggggcagaacttctaatgtttcttaatcacatggaaaaaatttctatttgtgaaatagataagagtactggagctctaaatgtgctgtattcagtaaagggcaaaatcacagatggagacagattgaaaaggaaacaatttcatgcatctgtaattgatagtgttactaaaaagaggcagctcaaagacataccagttcaacaaataacctatactatggatactgaggactctgaaggaaatcttactacgtggctaatttgtaatagatcaggcttttcaagtatggagaaagtatctaaaagtgtcatatcagctcacaagaaccaagatattactcttttcccacgtggtggagtagctgcctgcattactcacaactataaaaaaccccatagggccttctgttttttgcctctttctttggagactgggctgccatttcatgtgaatggccactttgcactggattcagccagaaggaacctgtggcgtgatgataatggagttggtgttcgaagtgactggaataacagtttaatgacagcattaatagctcctgcatatgttgaattgctaatacagttaaaaaaacggtatttccctggttctgatccaacattatcagtgttacagaacacccctattcatgttgtaaaggacactttaaagaagtttttatcgtttttcccagttaaccgtcttgatctacagccagatttatattgtctagtgaaagcactttacaattgcattcacgaagacatgaaacgtcttttacctgttgtgcgggctccaaatattgatggctctgacttgcactctgcagttataattacttggatcaatatgtctacttctaataaaactagaccattttttgacaatttactacaggatgaattacaacaccttaaaaatgcagattataatatcaccacacgcaaaacagtagcagagaatgtctataggctgaaacatctccttttagaaattggtttcaacttggtttataactgtgatgaaactgctaatctttaccactgtcttatagatgcagatattcctgttagttatgtgacccctgctgatatcagatcttttttaatgacattttcctctcctgacactaattgccatattgggaagctgccttgtcgtctgcagcagactaatctaaaactttttcatagtttaaaacttttagttgattattgttttaaagatgcagaagaaaatgagattgaagttgagggattgccccttctcatcacactggacagtgttttgcaaacttttgatgcaaaacgacccaagtttctaacaacatatcatgaattgattccatcccgcaaagacttgtttatgaatacattatatttgaaatatagtaatattttattgaactgtaaagttgcaaaagtgtttgacatttccagctttgctgatttgttatcctctgtgttgcctcgagaatataagaccaaaagttgcacaaagtggaaagacaattttgcaagtgagtcttggcttaagaatgcatggcattttattagtgaatctgtaagtgtgaaagaagatcaggaagaaacaaaaccaacatttgacattgttgttgatactctaaaagactgggcattgcttccaggaacaaagtttactgtttcagccaaccagcttgtggttcctgaaggagatgttctgcttcctctcagccttatgcacattgcagtttttccaaatgcccagagtgataaagtttttcatgctctaatgaaagctggctgtattcagcttgctttgaacaaaatctgttccaaagacagtgcatttgttcctttgttgtcatgtcacacagcaaatatagagagccccacaagcatcttgaaggctctacattatatggtccaaacttcaacatttagagcagaaaaattagtagaaaatgattttgaggcacttttgatgtatttcaactgcaatttgaatcatttgatgtcccaagatgatataaaaattctaaagtcacttccgtgctataaatccatcagtggccgctatgtaagcattggaaaatttggaacatgctacgtacttacaaaaagtatcccttcagctgaagtggagaaatggacacagtcatcatcatctgcatttcttgaagaaaaaatacacttaaaagaactatatgaggtgattggttgtgtacctgtagatgatcttgaggtatatttgaaacacctcttaccaaaaattgaaaatctctcttatgatgcaaaattagagcacttgatctaccttaagaatagattatcaagtgctgaggaattatcagagattaaggaacaactttttgaaaaactggaaagtttattgataatccatgatgctaacagtagactaaagcaagcaaagcatttctatgatagaactgtgagagtttttgaagttatgcttcctgaaaaattgtttattcctaatgatttctttaagaaattggaacaacttataaaacccaaaaatcatgttacatttatgacatcctgggtggaattcttaagaaatattggactaaaatacatactttctcagcagcagttgttacagtttgctaaggaaatcagtgtgagggctaatacagaaaactggtccaaagaaacattgcaaaatacagttgatatccttctgcatcatatattccaagaacgaatggatttgttatctggaaattttctgaaagaactatctttaataccattcttatgtcctgagcgggcccccgcggaattcattagatttcatcctcaatatcaagaggtaaatggaacacttcctcttataaagttcaatggagcacaggtaaatccaaaattcaagcaatgtgatgtactccagctgttatggacatcctgccctattcttccagagaaagctacacccttaagcattaaagaacaagaaggtagtgaccttggtccacaagaacagcttgaacaagttttaaatatgcttaatgttaacctggatcctcctcttgataaggtaatcaataactgcagaaacatatgcaacataacgacgttggatgaagaaatggtaaaaactagagcaaaagtcttaaggagcatatatgaattcctcagtgcagaaaaaagggaatttcgttttcagttgcgaggggttgcttttgtgatggtagaagatggttggaaacttctgaagcctgaggaggtagtcataaacctagaatatgaatctgattttaaaccttatttgtacaagctacctttagaacttggcacatttcaccagttgttcaaacacttaggtactgaagatattatttcaactaagcaatatgttgaagtgttgagccgcatatttaaaaattctgagggcaaacaattagatcctaatgaaatgcgtacagttaagagagtagtttctggtctgttcaggagtctacagaatgattcagtcaaggtgaggagtgatctcgagaatgtacgagaccttgcgctttacctcccaagccaggatggtagattggtaaagtcaagcatcttagtgtttgacgatgcgccacattataaaagtagaatccaggggaatattggtgtgcaaatgttagttgatctcagccagtgctacttagggaaagaccatggatttcacactaagttgataatgctctttcctcaaaaacttagacctcgattattgagcagtatacttgaagaacaattagatgaagagactcccaaagtttgtcagtttggagcgttgtgttctcttcaaggaagattgcagttactcttgtcttctgaacagttcattacaggactgattagaattatgaagcatgaaaatgataatgcttttctggccaatgaagaaaaagccataagactttgcaaagccctaagagaaggattgaaagtatcctgctttgaaaagcttcaaacaacattaagagttaaaggttttaatcctattccccacagcagaagtgaaacttttgcttttttgaagcgatttggtaatgcagtcatcttgctctacattcaacattcagacagtaaagacattaatttcctgttagcattggcaatgactcttaaatcagcaactgacaatttgatttctgacacttcatatttaattgctatgctaggatgcaatgatatttacaggattggtgagaaacttgacagtttaggagtgaaatatgactcttcggagccatcaaaactggaacttccaatgcctggcacaccaattcctgctgaaattcattacactctgcttatggacccaatgaatgttttttacccgggagaatatgttgggtaccttgttgatgctgaaggtggtgatatctatggatcataccagccaacatacacatatgcaattattgtacaagaagttgaaagagaagatgctgacaattctagttttctaggaaagatatatcagatagatattggttatagtgaatataaaatagttagctctcttgatctgtataagttttcaagacctgaggaaagctctcaaagcagggacagtgctccttctacaccaaccagccccactgagttcctcacccctggcctgagaagcattcctcctcttttctctggtagagagagccacaagacttcttccaaacatcagtcccccaaaaagcttaaggttaattctttaccagaaatcttaaaagaagtgacatctgtggtggagcaagcatggaagcttccagaatcggaacgaaaaaagattattaggcggttgtatttgaaatggcatcctgacaaaaatccagagaaccatgacattgccaatgaagtttttaaacatttgcagaatgaaatcaacagattagaaaaacaggcttttctagatcaaaatgcagacagggcctccagacgaacattttcaacctcagcatcccgatttcagtcagacaaatactcatttcagagattctatacttcatggaatcaagaagcaacgagccataaatctgaaagacagcaacagaacaaagaaaaatgccccccttcagccggacagacttactctcaaaggttctttgttcctcccactttcaagtcggttggcaatccagtggaagcacgcagatggctaagacaagccagagcaaacttctcagctgccaggaatgaccttcataaaaatgccaatgagtgggtgtgctttaaatgttacctttctaccaagttagctttgattgcagctgactatgctgtgaggggaaagtctgataaagatgtaaaaccaactgcacttgctcagaaaatagaggaatatagtcagcaacttgaaggactgacaaatgatgttcacacattggaagcttatggtgtagacagtttaaaaacaagataccctgatttgcttccctttcctcagatcccaaatgacaggttcacttctgaggttgctatgagggtgatggaatgtactgcctgtatcataataaaacttgaaaattttatgcaacaaaaagtgtgaagatatttaacgaaaaaaaaggtagatcttgaatgtgttgtagcacgaataaattgctgtacttcattaagcttcattgccaattagctaggaattgttaagcacattgcagattgttcttggagaattctggagttgttatgaacatgaataccaacggaaaaccttaactgaatctaaaagaaaactattttgaagatggtggtgagctgcaaaatagctggatggatttgaatgattgggatgatacatcattgaactgcactttatataaccaaagcttagcagtttgttagataagagtctatgtatgtctctggttaggatgaagttaattttatgtttttaacatggtatttttgaaggagctaatgaaacactggacatataattggtttaaacataaggggaattaagtctttgtagtctgtcatttttttaagtggatcctcttggatgcgttattttctcatcagctggctctgatcatgaatttgttgtaattttatgttgtactcagtgcatttaagaaatggtagagtattttaatcctattacttgactaagagtgtgaaggtagtactttttagagtgcactgagtgcactttacatctttatttaaatttttttttaacatcttatgtttacaggcttcctgtttgatgaagatagcaacggaaaactcaaaatggtggcagttcttattaccagttgttagtattgtttctggaaactgcttgccaagacaacatttattaactgttagaacacttgctttatgtttgtgtgtacatattttccacaaatgttataatttatatagtgtggttgaacaggatgcaatcttttgttgtctaaaggtgctgcagttaaaaaaaaaacaaccttttctttcaatatggcatgtagtggagtttttttaactttaaaaacatcaaaaattgttaaaatcattgtgttatctagtagtttataattatcggcttatatttccccatgaatgatcagaactgacatttaattcatgtttgtctcgccatgcttctttactttaacatatttcttttgcagaatgtaaaaggtaatgataattagtttatataagtgtactggctgtaaatgatgctaaatatactttatgcaattaagggcttacagaacatgttgaaactttttttacttttattgggaataaggaatgtttgcacctccacattttattgcttctggatgtgaaatcatgtaattatttctgctgttatataaagtgccatacttttaataaaggaaaatgtacatatgaaatcat

SEQ ID NO: 29605 - DNA, 15134 bp, Homo sapiens
ctgctcctcggccgccgcggcttcctctagcgtttcctcctcggcgcgggctgctgcgtacgggactgcgccatgcggatcccgccctcccggcccgcgcggggcctgtggacgcggtagggccggccgtgatcgggcgccggcgtcaggggcgggcgctaggggcgcctgccgcgccgcgatgtgggagaggtgggtcccggtgaccgtgctccccggctgcgtgggctgcaggaccgtcgcggcgctggcgtcctggaccgtgcgcgatgtgaaggaacgtatcttcgcggagactggcttcccggtgtcggagcagcggctgtggcgcggcggccgcgaggtcgatttggtcagacaacgccaccacttgttgattttctcaaggacattttgagaagatatccagaaggaggacagattcttaaggaattaattcagaatgcagaagatgctggggcgacagaagttaaatttttatatgatgaaactcaatacggaacagagactctttggtcaaaagatatggcgccatatcaggggccagctctctatgtgtacaacaacgcggttttcaccccagaggactggcacggcattcaagaaatagcaagaagcaggaaaaaggatgatcctctgaaggtcggaagatttggaattgggtttaattctgtctatcatataacagatgttccttgtatctttagtggtgaccaaatcgggatgctagatcctcatcaaacactttttggcccacatgaatcaggccaatgttggaatctcaaagatgacagcaaagaaattagtgaactttcagaccagtttgcaccatttgttggcatttttggaagcaccaaggaaacatttataaacggcaattttccaggaacatttttccgtttccctcttcgcctacaaccttcacaacttagtagtaacctctacaataagcagaaggttcttgagttgtttgagtcttttagggcagatgcagacacagtgctgctctttctgaaaagtgtgcaggatgtttccttatatgtccgagaggctgacggaacagagaaactggtgtttagagtgacttcgagtgagagtaaggcactgaaacatgagcggccgaattctataaagattctgggaactgctataagtaactattgtaaaaagactccaagcaataacatcacctgtgtaacatatcacgtaaatattgttttagaagaggagagtactaaggatgcacagaaaacatcttggttggtgtgtaacagtgtgggtgggcgagggatcagtagtaagcttgactctttagctgatgaactgaaatttgtcccaatcattggaatagccatgcctttatcaagcagagatgatgaagcaaaaggagcaacgtctgatttctcaggaaaagcattttgtttccttcctttaccacctggtgaggaaagcagcacaggcctcccagttcacatcagtgggttctttggccttactgataaccgcaggagcataaaatggagagagctggaccagtggagagacccggcagccttatggaatgagtttcttgtcatgaatgttgtccccaaagcttatgctactctgatcttagattcaataaaacgtctggagatggaaaagagctctgatttccccttgtcagttgatgttatctataagctttggccggaggcgagcaaagtcaaggtgcactggcaaccggtgttagagcctctattcagcgagctgttgcagaatgcagtgatttattcaattagctgtgactgggtcaggttggagcaggtgtacttctcagaacttgatgaaaatttagaatacacaaaaactgtgctcaactacctccagagctcagggaagcagattgccaaggtaccagggaatgtggatgctgctgttcagctcacagctgcctctggcacaacacctgtgaggaaggtgacgcccgcgtgggtgcggcaggtgctgcggaagtgtgcacacctgggctgtgctgaagaaaagcttcaccttctagaatttgtgctttctgaccaagcctacagtgagctgcttgggctggagctgctccctttacaaaatggcaattttgtccccttctcctcatctgtatcagaccaagatgtcatttatattacctcagcagaatatccaaggtcccttttcccaagtcttgaaggaagatttattttggataacttgaaacctcaccttgtggctgctttaaaggaagctgcccaaacccgaggaagaccatgtactcagctgcagcttctaaatccagaacgatttgcacgtcttatcaaggaagtaatgaatacattctggcctggcagagaattgattgttcaatggtatccatttgatgaaaacagaaatcacccatctgtttcatggcttaagatggtttggaaaaatctttatatacatttttcagaggatttgactttatttgatgagatgccacttatccccagaactatactagaggaaggtcagacatgtgtggaactcattagactcaggattccatcgttagtcattttagacgatgaatctgaagcacagcttccagaatttttagcagacattgtacaaaaacttggagggtttgtccttaaaaaattagatgcatctatacaacatccgcttattaaaaaatatattcattcaccattaccaagtgctgttttgcagataatggagaagatgccattgcagaaattgtgtaatcaaataacttcgctacttccaacacacaaagatgccctgaggaagttcttggctagtttaaccgatagcagtgagaaagagaaaagaattattcaagaattggcaatattcaagcgcattaaccattcttctgatcagggaatttcctcttatacaaaattgaaaggttgtaaagtcttacaccatactgccaaactcccagcagatctgcgactttctatttcagtaatagacagtagtgatgaagctactattcgtctggcaaacatgttgaaaatagaacagttaaagaccactagctgcttaaagcttgttttaaaagatattgaaaatgcattttattcacatgaagaggtaacacagcttatgttatgggtccttgagaatctatcttctcttaaaaatgagaatccaaatgtgcttgagtggttaacaccattaaaattcatccagatatcacaggaacagatggtatcagctggtgaactctttgaccctgatatagaagtactaaaggatctcttttgtaatgaagaaggaacctatttcccaccctcagtttttacctcaccagatattcttcactccttaagacagattggtttaaaaaacgaagccagtctcaaagaaaaggatgttgtgcaagtggcaaaaaaaattgaagccttacaggtcggtgcttgtcctgatcaagatgttcttctgaagaaagccaaaaccctcttactggttttaaataagaatcacacactgttgcaatcatctgaaggaaagatgacattgaagaaaataaaatgggttccagcctgcaaggaaaggcctccaaattatccaggctctttggtctggaaaggagatctctgtaatctctgtgcaccaccagatatgtgtgatgtaggccatgcaattctcattggctcctcacttcctcttgttgaaagtatccatgtaaacctggaaaaagcattagggatcttcacaaaacctagccttagtgctgtcttaaaacactttaaaattgttgttgattggtattcttcaaaaacctttagtgatgaagactactatcaattccagcatattttgcttgagatttacggattcatgcatgatcatctaaatgaagggaaagattcttttagagccttaaaatttccatgggtttggactggcaaaaagttttgtccacttgcccaggctgtgattaaaccaatccatgatcttgaccttcagccttatttgcataatgtacctaaaaccatggcaaaattccaccaactatttaaggtctgtggttcaatagaggagttgacatcagatcatatttccatggttattcagaagatatatctcaaaagtgaccaagatctcagtgaacaagaaagcaaacaaaatcttcatcttatgttgaatattatcagatggctgtatagcaatcagattccagcaagccccaacacaccagttcctatacatcatagcaaaaatccttctaaacttatcatgaagccaattcacgaatgctgttattgtgacattaaagttgatgaccttaatgacttacttgaagattctgtggaaccaatcattttggtgcatgaggacatacccatgaaaactgcagaatggctaaaagttccatgccttagtacaagactgataaatcctgaaaacatgggatttgagcagtcaggacaaagagagccacttactgtaagaattaaaaatattctggaagaatacccttcagtgtcagatatttttaaagaactacttcaaaacgctgatgatgcaaatgcaacagaatgcagtttcttgattgatatgagaagaaatatggacataagagagaatctcctagacccagggatggcagcttgtcatggacctgctttgtggtcattcaacaattctcaattctcagattcagattttgtgaacataactaggttaggagaatctttaaaaaggggagaagttgacaaagttggaaaatttggtcttggatttaattctgtgtaccatatcactgacattcccatcattatgagtcgggaattcatgataatgttcgatccaaacataaatcatatcagtaaacacattaaagacaaatccaatcctgggatcaaaattaattggagtaaacaacagaaaagacttagaaaatttcctaatcagttcaaaccatttatagatgtatttggctgtcagttacctttgactgtagaagcaccttacagctataatggaacccttttccgactgtcctttagaactcaacaggaagcaaaagtgagtgaagttagtagtacgtgctacaatacagcagatatttattctcttgtggatgaatttagtctctgtggacacaggcttatcattttcactcagagtgtaaagtcaatgtatttgaagtacttgaaaattgaggaaaccaaccccagtttagcacaagatacagtaataattaaaaaaaaatcctgctcttccaaagcattgaacacacctgtcttaagtgttttaaaagaggctgctaagctcatgaagacttgcagcagcagtaataaaaagcttcccagtgatgaaccaaagtcatcttgcattcttcagatcacagtggaagaatttcaccatgtgttcagaaggattgctgatttacagtcgccactttttagaggtccagatgatgacccagctgctctctttgaaatggctaagtctggccaatcaaaaaagccatcagatgagttgtcacagaaaacagtagagtgtaccacgtggcttctgtgtacttgcatggacacaggagaggctctgaagttttccctgagtgagagtggaagaagactaggactggttccatgtggggcagtaggagttcagctgtcagaaatccaggaccagaagtggacagtgaaaccacacattggagaggtgttttgctatttacctttacgaataaaaacaggcttgccagttcatatcaatgggtgctttgctgttacatcaaataggaaagaaatctggaaaacagatacaaaaggacgatggaataccacgttcatgagacatgttattgtgaaagcttacttacaggtactgagtgtcttacgggacctggccactagtggggagctaatggattatacttactatgcagtatggcccgatcctgatttagttcatgatgatttttctgtaatttgccaaggattttatgaagatatagctcatggaaaagggaaagaactgaccaaagtcttctctgatggatctacttgggtttccatgaagaacgtaagatttctagatgactctatacttaaaagaagagatgttggttcagcagccttcaagatatttttgaaatacctcaagaagactgggtccaaaaacctttgtgctgttgaacttccttcttcggtaaaattaggatttgaagaagctggctgcaaacagatactacttgaaaacacattttcagagaaacagtttttttctgaagtgttttttccaaatattcaagaaattgaagcagaacttagagatcctttaatgatctttgttctaaatgaaaaagttgatgagttctcgggagttcttcgtgttactccatgtattccttgttccttggaggggcatcctttggttttgccatcaagattgatccaccccgaaggacgagttgcaaagttatttgatattaaagatgggagattcccttatggttctactcaggattatctcaatcctattattttgattaaactagttcagttaggtatggcaaaagatgatattttatgggatgatatgctagaacgtgcagtgtcagtagctgaaattaataaaagtgatcatgttgctgcatgcctaagaagtagtatcttattgagtcttatcgatgagaaactaaaaataagggatcctagagcaaaggattttgctgcaaaatatcaaacaatccgcttccttccatttctgacaaaaccagcaggtttttctttggactggaaaggcaacagttttaagcctgaaaccatgtttgcagcaactgacctttatacagctgaacatcaagatatagtttgtcttttgcaaccaattctaaatgaaaattcccattcttttagaggttgtggttcagtgtcattggctgttaaagagtttttgggattactcaagaagccaacagttgatctggttataaaccaattgaaagaagtagcaaaatcagttgatgatggaattacactgtaccaggagaatatcaccaatgcttgctacaaataccttcatgaagccttgatgcaaaatgaaatcactaagatgtcaattattgataagttaaaaccctttagcttcattctagttgagaatgcatatgttgactcagaaaaggtttcttttcatttaaattttgaggcggcaccatacctttatcagttgcctaataagtataaaaataatttccgcgaactttttgaaaccgtgggtgtgaggcagtcatgcactgttgaagattttgctcttgttttggaatctattgatcaagaaagaggaacaaagcaaataacagaagagaattttcagctttgccgacgaataatcagtgaaggaatatggagtctcattagagaaaagaaacaagaattttgtgagaaaaattatggcaagatattattgccagatactaatcttatgcttctccctgctaaatcgttatgctacaatgattgcccttggataaaagtaaaggataccactgtaaaatattgtcatgctgacatacccagggaagtagcagtaaaactaggagcagtcccaaagcgacacaaagccttagaaagatatgcatccaatgtctgttttacaacacttggcacagaatttgggcagaaagaaaaattgaccagcagaattaagagcatccttaatgcatatccttctgaaaaggaaatgttgaaagagcttcttcaaaatgctgatgatgcaaaggcgacagaaatctgttttgtgtttgatcctagacagcatccagttgatagaatatttgatgataagtgggccccattgcaagggccagcactttgtgtgtacaacaaccagccatttacagaagatgatgttagaggaattcagaatcttggaaaaggcacgaaagagggaaatccttataaaactggacagtatggaataggattcaattctgtgtatcatatcacagactgcccatcttttatttctggcaatgacatcctgtgtatttttgatcctcatgccagatatgcaccaggggccacatccattagtcccggacgcatgtttagagatttggatgcagattttaggacacagttctcagatgttctggatctttatctgggaacccattttaaactggataattgcacaatgttcagatttcctcttcgtaatgcagaaatggcaaaagtttcggaaatttcgtctgttccagcatcagacagaatggtccagaatcttttggacaaactgcgctcagatggggcagaacttctaatgtttcttaatcacatggaaaaaatttctatttgtgaaatagataagagtactggagctctaaatgtgctgtattcagtaaagggcaaaatcacagatggagacagattgaaaaggaaacaatttcatgcatctgtaattgatagtgttactaaaaagaggcagctcaaagacataccagttcaacaaataacctatactatggatactgaggactctgaaggaaatcttactacgtggctaatttgtaatagatcaggcttttcaagtatggagaaagtatctaaaagtgtcatatcagctcacaagaaccaagatattactcttttcccacgtggtggagtagctgcctgcattactcacaactataaaaaaccccatagggccttctgttttttgcctctttctttggagactgggctgccatttcatgtgaatggccactttgcactggattcagccagaaggaacctgtggcgtgatgataatggagttggtgttcgaagtgactggaataacagtttaatgacagcattaatagctcctgcatatgttgaattgctaatacagttaaaaaaacggtatttccctggttctgatccaacattatcagtgttacagaacacccctattcatgttgtaaaggacactttaaagaagtttttatcgtttttcccagttaaccgtcttgatctacagccagatttatattgtctagtgaaagcactttacaattgcattcacgaagacatgaaacgtcttttacctgttgtgcgggctccaaatattgatggctctgacttgcactctgcagttataattacttggatcaatatgtctacttctaataaaactagaccattttttgacaatttactacaggatgaattacaacaccttaaaaatgcagattataatatcaccacacgcaaaacagtagcagagaatgtctataggctgaaacatctccttttagaaattggtttcaacttggtttataactgtgatgaaactgctaatctttaccactgtcttatagatgcagatattcctgttagttatgtgacccctgctgatatcagatcttttttaatgacattttcctctcctgacactaattgccatattgggaagctgccttgtcgtctgcagcagactaatctaaaactttttcatagtttaaaacttttagttgattattgttttaaagatgcagaagaaaatgagattgaagttgagggattgccccttctcatcacactggacagtgttttgcaaacttttgatgcaaaacgacccaagtttctaacaacatatcatgaattgattccatcccgcaaagacttgtttatgaatacattatatttgaaatatagtaatattttattgaactgtaaagttgcaaaagtgtttgacatttccagctttgctgatttgttatcctctgtgttgcctcgagaatataagaccaaaagttgcacaaagtggaaagacaattttgcaagtgagtcttggcttaagaatgcatggcattttattagtgaatctgtaagtgtgaaagaagatcaggaagaaacaaaaccaacatttgacattgttgttgatactctaaaagactgggcattgcttccaggaacaaagtttactgtttcagccaaccagcttgtggttcctgaaggagatgttctgcttcctctcagccttatgcacattgcagtttttccaaatgcccagagtgataaagtttttcatgctctaatgaaagctggctgtattcagcttgctttgaacaaaatctgttccaaagacagtgcatttgttcctttgttgtcatgtcacacagcaaatatagagagccccacaagcatcttgaaggctctacattatatggtccaaacttcaacatttagagcagaaaaattagtagaaaatgattttgaggcacttttgatgtatttcaactgcaatttgaatcatttgatgtcccaagatgatataaaaattctaaagtcacttccgtgctataaatccatcagtggccgctatgtaagcattggaaaatttggaacatgctacgtacttacaaaaagtatcccttcagctgaagtggagaaatggacacagtcatcatcatctgcatttcttgaagaaaaaatacacttaaaagaactatatgaggtgattggttgtgtacctgtagatgatcttgaggtatatttgaaacacctcttaccaaaaattgaaaatctctcttatgatgcaaaattagagcacttgatctaccttaagaatagattatcaagtgctgaggaattatcagagattaaggaacaactttttgaaaaactggaaagtttattgataatccatgatgctaacagtagactaaagcaagcaaagcatttctatgatagaactgtgagagtttttgaagttatgcttcctgaaaaattgtttattcctaatgatttctttaagaaattggaacaacttataaaacccaaaaatcatgttacatttatgacatcctgggtggaattcttaagaaatattggactaaaatacatactttctcagcagcagttgttacagtttgctaaggaaatcagtgtgagggctaatacagaaaactggtccaaagaaacattgcaaaatacagttgatatccttctgcatcatatattccaagaacgaatggatttgttatctggaaattttctgaaagaactatctttaataccattcttatgtcctgagcgggcccccgcggaattcattagatttcatcctcaatatcaagaggtaaatggaacacttcctcttataaagttcaatggagcacaggtaaatccaaaattcaagcaatgtgatgtactccagctgttatggacatcctgccctattcttccagagaaagctacacccttaagcattaaagaacaagaaggtagtgaccttggtccacaagaacagcttgaacaagttttaaatatgcttaatgttaacctggatcctcctcttgataaggtaatcaataactgcagaaacatatgcaacataacgacgttggatgaagaaatggtaaaaactagagcaaaagtcttaaggagcatatatgaattcctcagtgcagaaaaaagggaatttcgttttcagttgcgaggggttgcttttgtgatggtagaagatggttggaaacttctgaagcctgaggaggtagtcataaacctagaatatgaatctgattttaaaccttatttgtacaagctacctttagaacttggcacatttcaccagttgttcaaacacttaggtactgaagatattatttcaactaagcaatatgttgaagtgttgagccgcatatttaaaaattctgagggcaaacaattagatcctaatgaaatgcgtacagttaagagagtagtttctggtctgttcaggagtctacagaatgattcagtcaaggtgaggagtgatctcgagaatgtacgagaccttgcgctttacctcccaagccaggatggtagattggtaaagtcaagcatcttagtgtttgacgatgcgccacattataaaagtagaatccaggggaatattggtgtgcaaatgttagttgatctcagccagtgctacttagggaaagaccatggatttcacactaagttgataatgctctttcctcaaaaacttagacctcgattattgagcagtatacttgaagaacaattagatgaagagactcccaaagtttgtcagtttggagcgttgtgttctcttcaaggaagattgcagttactcttgtcttctgaacagttcattacaggactgattagaattatgaagcatgaaaatgataatgcttttctggccaatgaagaaaaagccataagactttgcaaagccctaagagaaggattgaaagtatcctgctttgaaaagcttcaaacaacattaagagttaaaggttttaatcctattccccacagcagaagtgaaacttttgcttttttgaagcgatttggtaatgcagtcatcttgctctacattcaacattcagacagtaaagacattaatttcctgttagcattggcaatgactcttaaatcagcaactgacaatttgatttctgacacttcatatttaattgctatgctaggatgcaatgatatttacaggattggtgagaaacttgacagtttaggagtgaaatatgactcttcggagccatcaaaactggaacttccaatgcctggcacaccaattcctgctgaaattcattacactctgcttatggacccaatgaatgttttttacccgggagaatatgttgggtaccttgttgatgctgaaggtggtgatatctatggatcataccagccaacatacacatatgcaattattgtacaagaagttgaaagagaagatgctgacaattctagttttctaggaaagatatatcagatagatattggttatagtgaatataaaatagttagctctcttgatctgtataagttttcaagacctgaggaaagctctcaaagcagggacagtgctccttctacaccaaccagccccactgagttcctcacccctggcctgagaagcattcctcctcttttctctggtagagagagccacaagacttcttccaaacatcagtcccccaaaaagcttaaggttaattctttaccagaaatcttaaaagaagtgacatctgtggtggagcaagcatggaagcttccagaatcggaacgaaaaaagattattaggcggttgtatttgaaatggcatcctgacaaaaatccagagaaccatgacattgccaatgaagtttttaaacatttgcagaatgaaatcaacagattagaaaaacaggcttttctagatcaaaatgcagacagggcctccagacgaacattttcaacctcagcatcccgatttcagtcagacaaatactcatttcagagattctatacttcatggaatcaagaagcaacgagccataaatctgaaagacagcaacagaacaaagaaaaatgccccccttcagccggacagacttactctcaaaggttctttgttcctcccactttcaagtcggttggcaatccagtggaagcacgcagatggctaagacaagccagagcaaacttctcagctgccaggaatgaccttcataaaaatgccaatgagtgggtgtgctttaaatgttacctttctaccaagttagctttgattgcagctgactatgctgtgaggggaaagtctgataaagatgtaaaaccaactgcacttgctcagaaaatagaggaatatagtcagcaacttgaaggactgacaaatgatgttcacacattggaagcttatggtgtagacagtttaaaaacaagataccctgatttgcttccctttcctcagatcccaaatgacaggttcacttctgaggttgctatgagggtgatggaatgtactgcctgtatcataataaaacttgaaaattttatgcaacaaaaagtgtgaagatatttaacgaaaaaaaaggtagatcttgaatgtgttgtagcacgaataaattgctgtacttcattaagcttcattgccaattagctaggaattgttaagcacattgcagattgttcttggagaattctggagttgttatgaacatgaataccaacggaaaaccttaactgaatctaaaagaaaactattttgaagatggtggtgagctgcaaaatagctggatggatttgaatgattgggatgatacatcattgaactgcactttatataaccaaagcttagcagtttgttagataagagtctatgtatgtctctggttaggatgaagttaattttatgtttttaacatggtatttttgaaggagctaatgaaacactggacatataattggtttaaacataaggggaattaagtctttgtagtctgtcatttttttaagtggatcctcttggatgcgttattttctcatcagctggctctgatcatgaatttgttgtaattttatgttgtactcagtgcatttaagaaatggtagagtattttaatcctattacttgactaagagtgtgaaggtagtactttttagagtgcactgagtgcactttacatctttatttaaatttttttttaacatcttatgtttacaggcttcctgtttgatgaagatagcaacggaaaactcaaaatggtggcagttcttattaccagttgttagtattgtttctggaaactgcttgccaagacaacatttattaactgttagaacacttgctttatgtttgtgtgtacatattttccacaaatgttataatttatatagtgtggttgaacaggatgcaatcttttgttgtctaaaggtgctgcagttaaaaaaaaaacaaccttttctttcaatatggcatgtagtggagtttttttaactttaaaaacatcaaaaattgttaaaatcattgtgttatctagtagtttataattatcggcttatatttccccatgaatgatcagaactgacatttaattcatgtttgtctcgccatgcttctttactttaacatatttcttttgcagaatgtaaaaggtaatgataattagtttatataagtgtactggctgtaaatgatgctaaatatactttatgcaattaagggcttacagaacatgttgaaactttttttacttttattgggaataaggaatgtttgcacctccacattttattgcttctggatgtgaaatcatgtaattatttctgctgttatataaagtgccatacttttaataaaggaaaatgtacatatgaaatcat

SEQ ID NO: 29606 - DNA, 7774 bp, Homo sapiens
gtaaccgccgggccaagatggctgcagaggaaggggtcgcgagtgctgcttccgccggcggtagctggggcaccgcggccatggggcgggttctaccgatgctgttggtgccagtccccgccgaggcgatggggcagctcggctcccgggcgcagctgcgcacacagccggaggctctggggagcctgacggctgcgggcagcctccaagtgctttctttgacgcctggcagccggggcgggggtcgctgctgcctggagggccccttctggcactttctatgggaggattctcgtaacagcagcacaccaactgaaaagcccaaactgctcgctcttggtgaaaattatgaactgcttatctatgaatttaatttgaaagatggaagatgtgatgcaaccattttgtatagctgtagtagggaggcattgcaaaagctcattgacgatcaagatatcagtatttccttattgtctttgagaatcctgtcatttcacaataacacatcattactgttcatcaacaaatgtgtcatcctacatattatatttcctgaaagagatgctgcaattagagtactcaactgtttcacacttcccttgcctgcacaggcagtggacatgattattgacacgcagctctgcagaggaattctttttgttttgagtagtttaggctggatctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctattttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctgggaggacagcctcaaggatgggcaccagctgaaacaactgctgctgaaggccctgactctgatgttggatgcagcagagagttatgccaaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccaggcttctattgtggctgaggcctacgattttgttccagattgggctgaaattttataccagcaagtgattcttaaaggagactttaattacttggaagaatttaagcagcaaaggttattaaagtccagtatatttgaagagatttccaaaaaatataaacaacatcagcctactgacatggtcatggaaaacctgaagaaattactcacatattgtgaagatgtttacctgtattacaagttggcatacgaacacaagttttatgaaattgtaaatgtgcttctgaaggaccctcagacaggttgctgtctaaaggacatgctagcaggttagatgatttcataggtgtctgttttcttgtactgttagcagattctgacagatgtgatgagaagaagaatgcattggagatctttgctaaagttgaacaatcccggtactgtaccatatcagtcctttgtgggtagtaggtagcaagtaagaaacttttcaggaggaaattcctatttaaaatagattgattttagatgattgttcatccacaccattttatatagatactagtattaagatcaaaagcttcctcttcctcaggacagcttctactttagatgatccaataatgattaaagaatacctgtacctgcagattccagtttcaaagaaatttaattattatttacacagttaaggaacaggtgatacattttcatttgttagaaactgatctttctgtaataaaatagattttcaattca

SEQ ID NO: 29607 - DNA, 7288 bp, Homo sapiens
agtgaccggaagtaaccgccgggccaagatggctgcagaggaaggggtcgcgagtgctgcttccgccggcggtagctggggcaccgcggccatggggcgggttctaccgatgctgttggtgccagtccccgccgaggcgatggggcagctcggctcccgggcgcagctgcgcacacagccggaggctctggggagcctgacggctgcgggcagcctccaagtgctttctttgacgcctggcagccggggcgggggtcgctgctgcctggagggccccttctggcactttctatgggaggattctcgtaacagcagcacaccaactgaaaagcccaaactgctcgctcttggtgaaaattatgaactgcttatctatgaatttaatttgaaagatggaagatgtgatgcaaccattttgtatagctgtagtagggaggcattgcaaaagctcattgacgatcaagatatcagtatttccttattgtctttgagaatcctgtcatttcacaataacacatcattactgttcatcaacaaatgtgtcatcctacatattatatttcctgaaagagatgctgcaattagagtactcaactgtttcacacttcccttgcctgcacaggcagtggacatgattattgacacgcagctctgcagaggaattctttttgttttgagtagtttaggctggatctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctattttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcagacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctgggaggacagcctcaaggatgggcaccagctgaaacaactgctgctgaaggccctgactctgatgttggatgcagcagagagttatgccaaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccaggcttctattgtggctgaggcctacgattttgttccagattgggctgaaattttataccagcaagtgattcttaaaggagactttaattacttggaagaatttaagcagcaaaggttattaaagtccagtatatttgaagagatttccaaaaaatataaacaacatcagcctactgacatggtcatggaaaacctgaagaaattactcacatattgtgaagatgtttacctgtattacaagttggcatacgaacacaagttttatgaaattgtaaatgtgcttctgaaggaccctcagacaggttgctgtctaaaggacatgctagcaggttagatgatttcataggtgtctgttttcttgtactgttagcagattctgacagatgtgatgagaagaagaatgcattggagatctttgctaaagttgaacaatcccggtactgtaccatatcagtcctttgtgggtagtaggtagcaagtaagaaacttttcaggaggaaattcctatttaaaatagattgattttagatgattgttcatccacaccattttatatagatactagtattaagatcaaaagcttcctcttcctcaggacagc

SEQ ID NO: 29608 - DNA, 6426 bp, Homo sapiens
gaaagtgaccggaagtaaccgccgggccaagatggctgcagaggaaggggtcgcgagtgctgcttccgccggcggtagctggggcaccgcggccatggggcgggttctaccgatgctgttggtgccagtccccgccgaggcgatggggcagctcggctcccgggcgcagctgcgcacacagccggaggctctggggagcctgacggctgcgggcagcctccaagtgctttctttgacgcctggcagccggggcgggggtcgctgctgcctggagggccccttctggcactttctatgggaggattctcgtaacagcagcacaccaactgaaaagcccaaactgctcgctcttggtgaaaattatgaactgcttatctatgaatttaatttgaaagatggaagatgtgatgcaaccattttgtatagctgtagtagggaggcattgcaaaagctcattgacgatcaagatatcagtatttccttattgtctttgagaatcctgtcatttcacaataacacatcattactgttcatcaacaaatgtgtcatcctacatattatatttcctgaaagagatgctgcaattagagtactcaactgtttcacacttcccttgcctgcacaggcagtggacatgattattgacacgcagctctgcagaggaattctttttgttttgagtagtttaggctggatctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctattttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggtgccctaccccccggggattcccaacctctctgacagcattctctagttcccagtgttaaggatttggatgttgtgcttatatacatcctgtatgtggttctctcaagtttctggattgcagtaatgtattttgtttaaataaaacaaaatacatgctttattttttacaaaatacatgtacaaaatac

SEQ ID NO: 29609 - DNA, 4820 bp, Homo sapiens
accagtaccagcccccaccttccgtctgtgcatgttttcttcagtcctggaaggaaatcataagtgatttgccccaaaaggattgctgttgaaaatggagcaagagccacaaaatggagaacctgctgaaattaagatcatcagagaagcatataagaaggcctttttatttgttaacaaaggtctgaatacagatgaattaggtcagaaggaagaagcaaagaactactataagcaaggaataggacacctgctcagagggatcagcatttcatcaaaagagtctgaacacacaggtcctgggtgggaatctgctagacagatgcaacagaaaatgaaagaaactctacagaatgtacgcaccaggctggaaattctagagaagggtcttgccacttctctgcagaatgatcttcaggaggtgcccaagttatatccagaatttccacctaaagacatgtgtgaaaaattaccagagcctcagtcttttagttcagctcctcagcatgctgaagtaaatggaaacacctcaactccaagtgcaggggcagttgctgcacctgcttctctgtctttaccatcacaaagttgtccagcagaagctcctcctgcttatactcctcaagctgctgaaggtcactacactgtatcctatggaacagattctggggagttttcatcagttggagaggagttttataggaatcattctcagccaccgcctcttgagaccttagggctggatgcagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatctgttaaggcaaatgtctgaccttcggctccaggccaactggaacagagcagaagaagaaaatgaattccaaatccctggaagaactagaccctcctctgaccaactaaaagaagcctctggcactgatgtgaaacagttggaccaaggcaataaggatgtacgtcataaaggaaaacgtggaaaaagggctaaagatacttcaagtgaagaagttaacctgagtcacattgtaccatgtgagccagttccagaagaaaagccaaaagaattacctgaatggagtgaaaaagtggctcacaacattttgtcaggtgcttcctgggtgagttggggtttagtcaaaggtgctgagattactggtaaggcaatccagaaaggtgcttctaaactccgagagcggattcaaccagaagaaaaacccgtggaagttagtccagctgtcaccaagggactttatatagcgaagcaagctacaggaggagcagcaaaagtcagtcagttcctggttgatggagtttgcactgtagcaaattgcgttggaaaagaactagctccacatgtcaagaagcatggaagcaaacttgttccagaatctcttaaaaaagacaaagatgggaaatctcctctggatggtgctatggttgtagcagcaagtagtgttcaaggattttcaactgtctggcaaggattggaatgtgcagctaaatgcatcgttaacaatgtttcagcagaaactgtacaaactgtcagatacaaatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaataaataaaaatagattattacgtcttttgtattgagactgtattgttatgagcctaggaaatttgggaacatgattgtattgtattaaaattcgaagtgattattatcagcttaattggattaaaaaagtacttcaagaaattattttatcatatctgcttctgtttttccaaaaggttaaaacttgtaaaaaaaatatatataaacaattgagtttactaatggtaaacatttttattctgggattcggtcattggaatttatattaaaagacaagttattaaaaaggaaaggttctattcataatcagggtaaagaatatgaaaaccttagacgtaatccatggtggataggcattatggtttccactttggcagaaggcagactattcacagccctatttacttacataggctaaaaaactatgtaactaaatacctaatggtatttaatttttgtttattgaatttaagagattggtattagttttcatagctgtagtccattctaataatttctgatcttctagtggctacttaattagacattatttgaagctgtctgaagaatgcactttatgaattaaaaaactgaattgcctgacctcgttatcacatgagcttatattttgggaacacatagaactgatggaggcttttcctaaggccaaggataatgtactagttgttaaaatggaaataaaagtgaagtggtaaatagcttacagacagtctatgctttgtttaagaaatggaatggcacttcatatattctcatttgtgggagctaaaaattacaataatcaaacttaaggagatagagagtagaatgatggttaccagaggctgggaggcattgaagggatggggagggaagtgaggttgattaatgggtacgaaaatatagttagaacgaatttgttgtagtatttgatagcccaacagggtgactacagtcaacaataactttatacatttaaaaataaaagagtgtaattgggacgtttgtaacacaaatgaatgcttgaagcagtagatacaccctgatgtaattattataaatcgcatacctgtatcaaaatatctcatgtatcccataaatatatacacctaccatgtacccataaaaatttaaaaagaaatggaatggcaaataatggaacataaactttaaacagttagctttgaccagaggtcagcaaatatcctccatgggctaaatccagatgtccacctgttttcataaataacgttttattggagcatagctgtacccatttgtttacatattggctatggctgctgtctagttcaacgtgagagttgaatagttgcatcagagagtatatggtccacaagcctaacttattcactctctggccctttgcagaaaaagtgtgctgccttagtctatagaaaatggacttttcccaccattcactgactcattaggagataggcatcttctaaagattttttttatattgtgtaatgattgatatatagataaaattatatattacttgtaaggtatgatgaataacaacacttaaaaactcatcacacctaaagacatggaaagctgccaattacctatatgtatgttcttcctattttcttacctctttccccatgtcattttttattgttccttgccattttttaatcacacatgtatgttctccaaacatactgtttcattttttgaagctttctacatatagtgtctgaatgtgaagtcttactcaacttgcttttttgagtttatgtttaaaattcattcttgcgcttatatgcatggatggtttacttgctctatagtattctgtgtgagtataccacaatttaagtgttcattttcctatcagttgacatttgtttttagtttttgttggtagaaacagtacactcaaaacatccttgactgtcccctggtacacatatgcaagagactttatgcgtaagagtggagttgttggcttgtcaagttttgcaaaataatgccaggtattttccaaaatgatgatattctcttgagtattacttccctttgcaatgtttttattgttaatgtagcatatataaaaaagtatctcataatttt

SEQ ID NO: 29610 - DNA, 4996 bp, Homo sapiens
acgtgacctaggctgcggcggcggcgtgctgcgggctctgtggcgggagcgaggccgacgggcggggccgcgcggccgcgtgacgcgaagcgttcgagagcgcgcgtcgtggaacgtcttggttgccacggcaagcgcgcgcgcgaggccttgggaacctcgggaccggcccccggcgagcgcagcggcgcccagtagtcatcttagtgggatttggggaagcaacagggctgtgtggggtaacctgccacctttaagtggaaatcagaaatggagcaagagccacaaaatggagaacctgctgaaattaagatcatcagagaagcatataagaaggcctttttatttgttaacaaaggtctgaatacagatgaattaggtcagaaggaagaagcaaagaactactataagcaaggaataggacacctgctcagagggatcagcatttcatcaaaagagtctgaacacacaggtcctgggtgggaatctgctagacagatgcaacagaaaatgaaagaaactctacagaatgtacgcaccaggctggaaattctagagaagggtcttgccacttctctgcagaatgatcttcaggaggtgcccaagttatatccagaatttccacctaaagacatgtgtgaaaaattaccagagcctcagtcttttagttcagctcctcagcatgctgaagtaaatggaaacacctcaactccaagtgcaggggcagttgctgcacctgcttctctgtctttaccatcacaaagttgtccagcagaagctcctcctgcttatactcctcaagctgctgaaggtcactacactgtatcctatggaacagattctggggagttttcatcagttggagaggagttttataggaatcattctcagccaccgcctcttgagaccttagggctggatgcagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatctgttaaggcaaatgtctgaccttcggctccaggccaactggaacagagcagaagaagaaaatgaattccaaatccctggaagaactagaccctcctctgaccaactaaaagaagcctctggcactgatgtgaaacagttggaccaaggcaataaggatgtacgtcataaaggaaaacgtggaaaaagggctaaagatacttcaagtgaagaagttaacctgagtcacattgtaccatgtgagccagttccagaagaaaagccaaaagaattacctgaatggagtgaaaaagtggctcacaacattttgtcaggtgcttcctgggtgagttggggtttagtcaaaggtgctgagattactggtaaggcaatccagaaaggtgcttctaaactccgagagcggattcaaccagaagaaaaacccgtggaagttagtccagctgtcaccaagggactttatatagcgaagcaagctacaggaggagcagcaaaagtcagtcagttcctggttgatggagtttgcactgtagcaaattgcgttggaaaagaactagctccacatgtcaagaagcatggaagcaaacttgttccagaatctcttaaaaaagacaaagatgggaaatctcctctggatggtgctatggttgtagcagcaagtagtgttcaaggattttcaactgtctggcaaggattggaatgtgcagctaaatgcatcgttaacaatgtttcagcagaaactgtacaaactgtcagatacaaatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaataaataaaaatagattattacgtcttttgtattgagactgtattgttatgagcctaggaaatttgggaacatgattgtattgtattaaaattcgaagtgattattatcagcttaattggattaaaaaagtacttcaagaaattattttatcatatctgcttctgtttttccaaaaggttaaaacttgtaaaaaaaatatatataaacaattgagtttactaatggtaaacatttttattctgggattcggtcattggaatttatattaaaagacaagttattaaaaaggaaaggttctattcataatcagggtaaagaatatgaaaaccttagacgtaatccatggtggataggcattatggtttccactttggcagaaggcagactattcacagccctatttacttacataggctaaaaaactatgtaactaaatacctaatggtatttaatttttgtttattgaatttaagagattggtattagttttcatagctgtagtccattctaataatttctgatcttctagtggctacttaattagacattatttgaagctgtctgaagaatgcactttatgaattaaaaaactgaattgcctgacctcgttatcacatgagcttatattttgggaacacatagaactgatggaggcttttcctaaggccaaggataatgtactagttgttaaaatggaaataaaagtgaagtggtaaatagcttacagacagtctatgctttgtttaagaaatggaatggcacttcatatattctcatttgtgggagctaaaaattacaataatcaaacttaaggagatagagagtagaatgatggttaccagaggctgggaggcattgaagggatggggagggaagtgaggttgattaatgggtacgaaaatatagttagaacgaatttgttgtagtatttgatagcccaacagggtgactacagtcaacaataactttatacatttaaaaataaaagagtgtaattgggacgtttgtaacacaaatgaatgcttgaagcagtagatacaccctgatgtaattattataaatcgcatacctgtatcaaaatatctcatgtatcccataaatatatacacctaccatgtacccataaaaatttaaaaagaaatggaatggcaaataatggaacataaactttaaacagttagctttgaccagaggtcagcaaatatcctccatgggctaaatccagatgtccacctgttttcataaataacgttttattggagcatagctgtacccatttgtttacatattggctatggctgctgtctagttcaacgtgagagttgaatagttgcatcagagagtatatggtccacaagcctaacttattcactctctggccctttgcagaaaaagtgtgctgccttagtctatagaaaatggacttttcccaccattcactgactcattaggagataggcatcttctaaagattttttttatattgtgtaatgattgatatatagataaaattatatattacttgtaaggtatgatgaataacaacacttaaaaactcatcacacctaaagacatggaaagctgccaattacctatatgtatgttcttcctattttcttacctctttccccatgtcattttttattgttccttgccattttttaatcacacatgtatgttctccaaacatactgtttcattttttgaagctttctacatatagtgtctgaatgtgaagtcttactcaacttgcttttttgagtttatgtttaaaattcattcttgcgcttatatgcatggatggtttacttgctctatagtattctgtgtgagtataccacaatttaagtgttcattttcctatcagttgacatttgtttttagtttttgttggtagaaacagtacactcaaaacatccttgactgtcccctggtacacatatgcaagagactttatgcgtaagagtggagttgttggcttgtcaagttttgcaaaataatgccaggtattttccaaaatgatgatattctcttgagtattacttccctttgcaatgtttttattgttaatgtagcatatataaaaaagtatctcataatttt

SEQ ID NO: 29611 - DNA, 4789 bp, Homo sapiens
gcggccgcgcagggagctctcgaggcaacgccggggcgcccgaggtctggaaggcgcagaaatggagcaagagccacaaaatggagaacctgctgaaattaagatcatcagagaagcatataagaaggcctttttatttgttaacaaaggtctgaatacagatgaattaggtcagaaggaagaagcaaagaactactataagcaaggaataggacacctgctcagagggatcagcatttcatcaaaagagtctgaacacacaggtcctgggtgggaatctgctagacagatgcaacagaaaatgaaagaaactctacagaatgtacgcaccaggctggaaattctagagaagggtcttgccacttctctgcagaatgatcttcaggaggtgcccaagttatatccagaatttccacctaaagacatgtgtgaaaaattaccagagcctcagtcttttagttcagctcctcagcatgctgaagtaaatggaaacacctcaactccaagtgcaggggcagttgctgcacctgcttctctgtctttaccatcacaaagttgtccagcagaagctcctcctgcttatactcctcaagctgctgaaggtcactacactgtatcctatggaacagattctggggagttttcatcagttggagaggagttttataggaatcattctcagccaccgcctcttgagaccttagggctggatgcagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatctgttaaggcaaatgtctgaccttcggctccaggccaactggaacagagcagaagaagaaaatgaattccaaatccctggaagaactagaccctcctctgaccaactaaaagaagcctctggcactgatgtgaaacagttggaccaaggcaataaggatgtacgtcataaaggaaaacgtggaaaaagggctaaagatacttcaagtgaagaagttaacctgagtcacattgtaccatgtgagccagttccagaagaaaagccaaaagaattacctgaatggagtgaaaaagtggctcacaacattttgtcaggtgcttcctgggtgagttggggtttagtcaaaggtgctgagattactggtaaggcaatccagaaaggtgcttctaaactccgagagcggattcaaccagaagaaaaacccgtggaagttagtccagctgtcaccaagggactttatatagcgaagcaagctacaggaggagcagcaaaagtcagtcagttcctggttgatggagtttgcactgtagcaaattgcgttggaaaagaactagctccacatgtcaagaagcatggaagcaaacttgttccagaatctcttaaaaaagacaaagatgggaaatctcctctggatggtgctatggttgtagcagcaagtagtgttcaaggattttcaactgtctggcaaggattggaatgtgcagctaaatgcatcgttaacaatgtttcagcagaaactgtacaaactgtcagatacaaatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaataaataaaaatagattattacgtcttttgtattgagactgtattgttatgagcctaggaaatttgggaacatgattgtattgtattaaaattcgaagtgattattatcagcttaattggattaaaaaagtacttcaagaaattattttatcatatctgcttctgtttttccaaaaggttaaaacttgtaaaaaaaatatatataaacaattgagtttactaatggtaaacatttttattctgggattcggtcattggaatttatattaaaagacaagttattaaaaaggaaaggttctattcataatcagggtaaagaatatgaaaaccttagacgtaatccatggtggataggcattatggtttccactttggcagaaggcagactattcacagccctatttacttacataggctaaaaaactatgtaactaaatacctaatggtatttaatttttgtttattgaatttaagagattggtattagttttcatagctgtagtccattctaataatttctgatcttctagtggctacttaattagacattatttgaagctgtctgaagaatgcactttatgaattaaaaaactgaattgcctgacctcgttatcacatgagcttatattttgggaacacatagaactgatggaggcttttcctaaggccaaggataatgtactagttgttaaaatggaaataaaagtgaagtggtaaatagcttacagacagtctatgctttgtttaagaaatggaatggcacttcatatattctcatttgtgggagctaaaaattacaataatcaaacttaaggagatagagagtagaatgatggttaccagaggctgggaggcattgaagggatggggagggaagtgaggttgattaatgggtacgaaaatatagttagaacgaatttgttgtagtatttgatagcccaacagggtgactacagtcaacaataactttatacatttaaaaataaaagagtgtaattgggacgtttgtaacacaaatgaatgcttgaagcagtagatacaccctgatgtaattattataaatcgcatacctgtatcaaaatatctcatgtatcccataaatatatacacctaccatgtacccataaaaatttaaaaagaaatggaatggcaaataatggaacataaactttaaacagttagctttgaccagaggtcagcaaatatcctccatgggctaaatccagatgtccacctgttttcataaataacgttttattggagcatagctgtacccatttgtttacatattggctatggctgctgtctagttcaacgtgagagttgaatagttgcatcagagagtatatggtccacaagcctaacttattcactctctggccctttgcagaaaaagtgtgctgccttagtctatagaaaatggacttttcccaccattcactgactcattaggagataggcatcttctaaagattttttttatattgtgtaatgattgatatatagataaaattatatattacttgtaaggtatgatgaataacaacacttaaaaactcatcacacctaaagacatggaaagctgccaattacctatatgtatgttcttcctattttcttacctctttccccatgtcattttttattgttccttgccattttttaatcacacatgtatgttctccaaacatactgtttcattttttgaagctttctacatatagtgtctgaatgtgaagtcttactcaacttgcttttttgagtttatgtttaaaattcattcttgcgcttatatgcatggatggtttacttgctctatagtattctgtgtgagtataccacaatttaagtgttcattttcctatcagttgacatttgtttttagtttttgttggtagaaacagtacactcaaaacatccttgactgtcccctggtacacatatgcaagagactttatgcgtaagagtggagttgttggcttgtcaagttttgcaaaataatgccaggtattttccaaaatgatgatattctcttgagtattacttccctttgcaatgtttttattgttaatgtagcatatataaaaaagtatctcataattttaa

SEQ ID NO: 29612 - DNA, 4944 bp, Homo sapiens
cggaggcctcggtttcgctggagagaaagagattgcgcaggcgccgagcagccgacgtggccgcaggggaccgtgcctgggggggtctgcgcggggccgctgactcgcgaggttctctgtcgcctgccgccctcgctccttttctccccttctagagtgttacggtgactcttgggtccgaaggggacggacgtcctcccacgtaccatttagaagaaatggagcaagagccacaaaatggagaacctgctgaaattaagatcatcagagaagcatataagaaggcctttttatttgttaacaaaggtctgaatacagatgaattaggtcagaaggaagaagcaaagaactactataagcaaggaataggacacctgctcagagggatcagcatttcatcaaaagagtctgaacacacaggtcctgggtgggaatctgctagacagatgcaacagaaaatgaaagaaactctacagaatgtacgcaccaggctggaaattctagagaagggtcttgccacttctctgcagaatgatcttcaggaggtgcccaagttatatccagaatttccacctaaagacatgtgtgaaaaattaccagagcctcagtcttttagttcagctcctcagcatgctgaagtaaatggaaacacctcaactccaagtgcaggggcagttgctgcacctgcttctctgtctttaccatcacaaagttgtccagcagaagctcctcctgcttatactcctcaagctgctgaaggtcactacactgtatcctatggaacagattctggggagttttcatcagttggagaggagttttataggaatcattctcagccaccgcctcttgagaccttagggctggatgcagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatctgttaaggcaaatgtctgaccttcggctccaggccaactggaacagagcagaagaagaaaatgaattccaaatccctggaagaactagaccctcctctgaccaactaaaagaagcctctggcactgatgtgaaacagttggaccaaggcaataaggatgtacgtcataaaggaaaacgtggaaaaagggctaaagatacttcaagtgaagaagttaacctgagtcacattgtaccatgtgagccagttccagaagaaaagccaaaagaattacctgaatggagtgaaaaagtggctcacaacattttgtcaggtgcttcctgggtgagttggggtttagtcaaaggtgctgagattactggtaaggcaatccagaaaggtgcttctaaactccgagagcggattcaaccagaagaaaaacccgtggaagttagtccagctgtcaccaagggactttatatagcgaagcaagctacaggaggagcagcaaaagtcagtcagttcctggttgatggagtttgcactgtagcaaattgcgttggaaaagaactagctccacatgtcaagaagcatggaagcaaacttgttccagaatctcttaaaaaagacaaagatgggaaatctcctctggatggtgctatggttgtagcagcaagtagtgttcaaggattttcaactgtctggcaaggattggaatgtgcagctaaatgcatcgttaacaatgtttcagcagaaactgtacaaactgtcagatacaaatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaataaataaaaatagattattacgtcttttgtattgagactgtattgttatgagcctaggaaatttgggaacatgattgtattgtattaaaattcgaagtgattattatcagcttaattggattaaaaaagtacttcaagaaattattttatcatatctgcttctgtttttccaaaaggttaaaacttgtaaaaaaaatatatataaacaattgagtttactaatggtaaacatttttattctgggattcggtcattggaatttatattaaaagacaagttattaaaaaggaaaggttctattcataatcagggtaaagaatatgaaaaccttagacgtaatccatggtggataggcattatggtttccactttggcagaaggcagactattcacagccctatttacttacataggctaaaaaactatgtaactaaatacctaatggtatttaatttttgtttattgaatttaagagattggtattagttttcatagctgtagtccattctaataatttctgatcttctagtggctacttaattagacattatttgaagctgtctgaagaatgcactttatgaattaaaaaactgaattgcctgacctcgttatcacatgagcttatattttgggaacacatagaactgatggaggcttttcctaaggccaaggataatgtactagttgttaaaatggaaataaaagtgaagtggtaaatagcttacagacagtctatgctttgtttaagaaatggaatggcacttcatatattctcatttgtgggagctaaaaattacaataatcaaacttaaggagatagagagtagaatgatggttaccagaggctgggaggcattgaagggatggggagggaagtgaggttgattaatgggtacgaaaatatagttagaacgaatttgttgtagtatttgatagcccaacagggtgactacagtcaacaataactttatacatttaaaaataaaagagtgtaattgggacgtttgtaacacaaatgaatgcttgaagcagtagatacaccctgatgtaattattataaatcgcatacctgtatcaaaatatctcatgtatcccataaatatatacacctaccatgtacccataaaaatttaaaaagaaatggaatggcaaataatggaacataaactttaaacagttagctttgaccagaggtcagcaaatatcctccatgggctaaatccagatgtccacctgttttcataaataacgttttattggagcatagctgtacccatttgtttacatattggctatggctgctgtctagttcaacgtgagagttgaatagttgcatcagagagtatatggtccacaagcctaacttattcactctctggccctttgcagaaaaagtgtgctgccttagtctatagaaaatggacttttcccaccattcactgactcattaggagataggcatcttctaaagattttttttatattgtgtaatgattgatatatagataaaattatatattacttgtaaggtatgatgaataacaacacttaaaaactcatcacacctaaagacatggaaagctgccaattacctatatgtatgttcttcctattttcttacctctttccccatgtcattttttattgttccttgccattttttaatcacacatgtatgttctccaaacatactgtttcattttttgaagctttctacatatagtgtctgaatgtgaagtcttactcaacttgcttttttgagtttatgtttaaaattcattcttgcgcttatatgcatggatggtttacttgctctatagtattctgtgtgagtataccacaatttaagtgttcattttcctatcagttgacatttgtttttagtttttgttggtagaaacagtacactcaaaacatccttgactgtcccctggtacacatatgcaagagactttatgcgtaagagtggagttgttggcttgtcaagttttgcaaaataatgccaggtattttccaaaatgatgatattctcttgagtattacttccctttgcaatgtttttattgttaatgtagcatatataaaaaagtatctcataatttt

SEQ ID NO: 29613 - DNA, 1533 bp, Homo sapiens
agtctcgcgccagctgagcggcggtcgggcggggggagcgcggcggcccaagctcgctcggccacgcgccccgccccctcagaggccggcctcccgcacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctgttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatggtagacaggctagaaagtttgggtcagagtgaactggcttcaagacttaccttgaattgtcaaaattcttatgtggaacctcataaaattcgggacatacctgtaactattatggatgtgtttgatcagagtgcgctttcaactgaagctaaagaagaaatgtacaagctgtatcctaatgcccgaagagctcatctgaaaacaggaggcaatttcccatacctgtgcagaagtgcagaggtcaatctttatgtacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccggccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcagattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatca

SEQ ID NO: 29614 - DNA, 1822 bp, Homo sapiens
cgccctctgagaacccggaagcgggagtctcgcgccagctgagcggcggtcgggcggggggagcgcggcggcccaagctcgctcggccacgcgccccgccccctcagaggccggcctcccgcacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatggtagacaggctagaaagtttgggtcagagtgaactggcttcaagacttaccttgaattgtcaaaattcttatgtggaacctcataaaattcgggacatacctgtaactattatggatgtgtttgatcagagtgcgctttcaactgaagctaaagaagaaatgtacaagctgtatcctaatgcccgaagagctcatctgaaaacaggaggcaatttcccatacctgtgcagaagtgcagaggtcaatctttatgtacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccggccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcagattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaatttcactgag

SEQ ID NO: 29615 - DNA, 1613 bp, Homo sapiens
gggtggtcggtgtgcttgtgaccctgcctttgtgtggctgtcaccggtgggactggcggggagctgtgtgattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatggtagacaggctagaaagtttgggtcagagtgaactggcttcaagacttaccttgaattgtcaaaattcttatgtggaacctcataaaattcgggacatacctgtaactattatggatgtgtttgatcagagtgcgctttcaactgaagctaaagaagaaatgtacaagctgtatcctaatgcccgaagagctcatctgaaaacaggaggcaatttcccatacctgtgcagaagtgcagaggtcaatctttatgtacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccggccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcagattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaatttc

SEQ ID NO: 29616 - DNA, 3076 bp, Homo sapiens
ggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggaatgggtaccacagaccatgtcatcgtcctggcgtccacgaaccgagctgacattttggacggtgctctgatgaggccaggccgactggaccggcacgtcttcattgatctccccacgctgcaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcagggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 29617 - DNA, 1824 bp, Homo sapiens
atgaggctgcgctgcacgcggcgcgggagggacacacttccgtgcacactctcaacttcgagtacgccgtggagcgcgtcctcgcaggtccccagggctcagcttgggaaagcagtgggttcctgcagaggagtggggagctgctgtgccagacactgcaaaacacacctggcttctctccgacagccctgcggggagaggactggcgctgcctgtgtcttactgatttattttcgtgtaaccatttacttttatgtggaaatcgaaaagcttttgataatagtagcaaagcaggaaggactgagtgggaaccacaagccagttgaaagaaaatacatgacgtacttgagtgctcaggaccacgagctgattcaagttgtacagaatggacacttacagatgtgtggaaaatctgagacaggaaatgaagcctcaccaggactgccaaaaagagcaagatcctgtccaaggaagaacagaaagtggttgcgtttcatgagtcgggccacgccttggtgggctggatgctggagcacacggcgtgatgaaggtctccataacccctcgacaaacgccgccctgggctttgctcaggctccccagagaccagcacctcttcacgagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatct

SEQ ID NO: 29618 - DNA, 2211 bp, Homo sapiens
ctgggaccacaggcgtgcaccgttgtgcccaggtctaagtgtttcgatttagaaatggtttcctctaggtgggaaccactcctgctcctcactgaagtgacctcagcgaatgaagtgtgggtgacctcgaacagcacagcgttagtctttgtctctgataacgtcagggaagaattggaggaagtgcaggatcttctgtgcaggacgctgcccctccccgtccagctgagctttcctgaggaagctctggatgtcgcccgtgttgctcatgtgtttgtttctcccttttgcttctctgccggctcagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggtgcctctcttgaccagctaccctcccaggggaccatgaggaagctcagaggaaagacccccgcctgctcctgtctcacggagcccacagggtcacggagggcaatggagggtcattcgctctgctggggttgccttttgcactgaagatagagaccacctttttgagtgacttgagcccaaaggcaagcgtatatcaaacgatcttctccacataacctctctgtgccatcataagaatagctgcttccgcccccggatttgctcaggcctgggaatccgctgactgaaggcctcttgttgagtgccagctctaaacaagtccctttatgcagagccacagctgtgcatgctcagccctgccgaggtcccaggccaggctttgttgcttccgttcatggaagcgcacaggatagggccgacgctgtgccggtcgtggggaaatctcactggggaagagaaaagcccaagccttgttggttacgtcagccggtccatggcggtgtcctgcggaccccagagcccccgggaagggcgcaagtcaaagagcactggaggcaccgccggcgatggacgtccaggtcccggctcctgtgctggaaagcgttgatggggagcgtcggcgctgaccacacgcgggagctgcggaagcccagcggttcacacaggcctcccttcaacgtagtcatcccctggtggtggaagcaagacgacggcccctgacgtgcagccacacacagaaaaggctgctgtgaacattttatgcttcgactttttttttcttcagagacagggtgtcgttctgtcgcccaggctggagtgcagtgccaccatcatagctcactgcagcctccacctcctaggctcaagcttcctaagtagttgggactcaaggcttgagtcaccatgccaggctctgttttttcagtctgtgaaaaataaagtcatcagcatgtg

SEQ ID NO: 29619 - DNA, 2288 bp, Homo sapiens
ggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggtgcctctcttgaccagctaccctcccaggggaccatgaggaagctcagaggaaagacccccgcctgctcctgtctcacggagcccacagggtcacggagggcaatggagggtcattcgctctgctggggttgccttttgcactgaagatagagaccacctttttgagtgacttgagcccaaaggcaagcgtatatcaaacgatcttctccacataacctctctgtgccatcataagaatagctgcttccgcccccggatttgctcaggcctgggaatccgctgactgaaggcctcttgttgagtgccagctctaaacaagtccctttatgcagagccacagctgtgcatgctcagccctgccgaggtcccaggccaggctttgttgcttccgttcatggaagcgcacaggatagggccgacgctgtgccggtcgtggggaaatctcactggggaagagaaaagcccaagccttgttggttacgtcagccggtccatggcggtgtcctgcggaccccagagcccccgggaagggcgcaagtcaaagagcactggaggcaccgccggcgatggacgtccaggtcccggctcctgtgctggaaagcgttgatggggagcgtcggcgctgaccacacgcgggagctgcggaagcccagcggttcacacaggcctcccttcaacgtagtcatcccctggtggtggaagcaagacgacggcccctgacgtgcagccacacacagaaaaggctgctgtgaacattttatgcttcgactttttttttcttcagagacagggtgtcgttctgtcgcccaggctggagtgcagtgccaccatcatagctcactgcagcctccacctcctaggctcaagcttcctaagtagttgggactcaaggcttgagtcaccatgccaggctctgttttttcagtctgtgaaaaataaagtcatcagcatgtga

SEQ ID NO: 29620 - DNA, 5117 bp, Homo sapiens
gctcctgagaccggcgggcacacgggggtctgtggcccccgccgtagcagtggctgccgccgtcgcttggttcccgtcggtctgcgggaggcgggttatggcggcggcggcagtgagagctgtgaatgaattctccgggtggacgagggaagaagaaaggctccggcggcgccagcaacccggtgcctcccaggcctccgcccccttgcctggcccccgcccctcccgccgccgggccggcccctccgcccgagtcgccgcataagcggaacctgtactatttctcctacccgctgtttgtaggcttcgcgctgctgcgtttggtcgccttccacctggggctcctcttcgtgtggctctgccagcgcttctcccgcgccctcatggcagccaagaggagctccggggccgcgccagcacctgcctcggcctcggccccggcgccggtgccgggcggcgaggccgagcgcgtccgagtcttccacaaacaggccttcgagtacatctccattgccctgcgcatcgatgaggatgagaaagcaggacagaaggagcaagctgtggaatggtataagaaaggtattgaagaactggaaaaaggaatagctgttatagttacaggacaaggtgaacagtgtgaaagagctagacgccttcaagctaaaatgatgactaatttggttatggccaaggaccgcttacaacttctagagaagatgcaaccagttttgccattttccaagtcacaaacggacgtctataatgacagtactaacttggcatgccgcaatggacatctccagtcagaaagtggagctgttccaaaaagaaaagaccccttaacacacactagtaattcactgcctcgttcaaaaacagttatgaaaactggatctgcaggcctttcaggccaccatagagcacctagttacagtggtttatccatggtttctggagtgaaacagggatctggtcctgctcctaccactcataagggtactccgaaaacaaataggacaaataaaccttctacccctacaactgctactcgtaagaaaaaagacttgaagaattttaggaatgtggacagcaaccttgctaaccttataatgaatgaaattgtggacaatggaacagctgttaaatttgatgatatagctggtcaagacttggcaaaacaagcattgcaagaaattgttattcttccttctctgaggcctgagttgttcacagggcttagagctcctgccagagggctgttactctttggtccacctgggaatgggaagacaatgctggctaaagcagtagctgcagaatcgaatgcaaccttctttaatataagtgctgcaagtttaacttcaaaatacgtgggagaaggagagaaattggtgagggctctttttgctgtggctcgagaacttcaaccttctataatttttatagatgaagttgatagccttttgtgtgaaagaagagaaggggagcacgatgctagtagacgcctaaaaactgaatttctaatagaatttgatggtgtacagtctgctggagatgacagagtacttgtaatgggtgcaactaataggccacaagagcttgatgaggctgttctcaggcgtttcatcaaacgggtatatgtgtctttaccaaatgaggagacaagactacttttgcttaaaaatctgttatgtaaacaaggaagtccattgacccaaaaagaactagcacaacttgctagaatgactgatggatactcaggaagtgacctaacagctttggcaaaagatgcagcactgggtcctatccgagaactaaaaccagaacaggtgaagaatatgtctgccagtgagatgagaaatattcgattatctgacttcactgaatccttgaaaaaaataaaacgcagcgtcagccctcaaactttagaagcgtacatacgttggaacaaggactttggagataccactgtttaaggaaatacctttgtaaacctgcagaacattttacttaaaagaggaaacacaagatcttcaatgaacgtcatcggctacagaaacagcctaagtttacaggactttttagagtcttacatatttgtgcaccaaacttgaagatgaaccagaaaacagacttaaacaaaatatacaatgcaaatgtaattttttgttgtttaaggccttgccttgatggtcacagttatcccaatggacactaagttagagcacaacaaaacctgattctggtcttctttaccaatataatcataatgtaaataataatttgtatattgtgttgcagatgaaagtattccaggaacagtgaatggtagaagacacaagaacatttgtttgtttgtcttctgatgttttttcttaaaatagtaatttctcctacttttcttttctactgttgtcttaactacaggtgattggaatgccaaacactcttaagtttattttcttttttcgttttataaattcagtgtgccaaatgaaacttttttcctaagtaactgtaataggaaaaagtttattttgagagtttcttcttcataaatctacagacattaaacaattgttgtgttctttttaccttttatttttctattaccttgctaccaaacagtttagatagcaatataatagcaaaaaagcaaatatggtaaaatagagaaggtttgaaggtttgagttactctgtcatataacatgtagatcagtcttcatgtgacctgcagtatttttttttctaatgtatttgtcagaaatctgttgtagactgttaacttcttcctgatggaatttattttctgcaagaattattctgatatttaagagagccaattttaactgctgtgaaaatgtttccagtgcaagagaagggaaatactaggaactaagacatttctaatttattgcttattactttcttaattttacaggataattataagcaagtggaactaccatcttttattcttaataattattaatcccttcaatgaaactttaaaaaaactgaatttttatacatggcatacatttttctagttccttctgcttgctttattaactcaaaagttctagttctagtctgttgatctgccttttgttctcccaaaatgtacagtaattccatttgtttgtataaatatgcctggattttcattataaaaatgtcattgtagggagtagagactcatatcatggccttttaaatattgtaataaaggcaaatagatatttgcccttagtttactggttaaaagtttgtttacagaacttttctctggtgcttaaatgatgctatgtaaaatgtcatgagtggaaagaatatttgtagtagtaacaagaatttttcatttaggaaagatttcttaggttttgaaagaatacattaaaataaaaaacttgcccctactaggtaagaactttataatgaagacatacattcttcttaattttactcttgctcttgttaaagatttgtttgaatatagaagatgcatgatttctgggtttttttttttttttgagacagagtttcgctcttgttgcccaggctggagtgcaatggcgcaatctcgactcaccacaacctccgcctcccaggttcaagcaattctcctgcctcagcctcccgagtagctgggattacaggcatgcgccactaccccagctaattttgtatttttagtagagatggggtttctccatgttggtcaggctggtcttgaactcctgacctcaggtgatccgcctgcctcggcctcccaaagtgctgggattacaggcataagccactgcgcccagccagaagatgcatgatttcttaggatcatatgctgtttgtagccataaggtaaatcatgtctcttccaatcatgactttggaactccctgaataataaaaatgagagttgagataaataggggaaaaaaaatttttttcaagccagagctatgcatatgttaggtgatgggtagtatccctttaaggtctcaaacattacaacatcaattatgaaatactgataacgaaaggtagtaatgaaatatatatgatgaaaagaattgagaagttctaaattaagacatttcagttaagctcataaaatttcattgttttcatttaaaagattaacgttattgatacttggataactggctaatcatattaaaggactatgtggttccagctcaacttttaatatattgtctcctttaaaactatcatggttataattctattgggaaagacttttagataacaaagatttcaaatgttaaaagagataaaagtcaggttaatactatcttaaacactgagtcagaaaatcattactgtatagaagttgctttcctgatcaagtctgaacttcagctagtgctagagaactattttctatgacttaactctaaccaagttttattttaagctgtttctttgatagaagggccatgaaaatagagtaatgatatagtaggagataagggattggtttggtctttttcaataaagatagaagttgctgaagttttctgaattaataatgacttagattgtgaccttttagattcggtgttgagctctgtgttgtattacttcctaaaagataatgcttaaacattaagcattagtgtgctcttcatgttaatatggcagagttttgtaaactaaattaaaacttactgatatattggactttgagccaagggaaagaatgagtactatctttccagatatcttaagggtaaaagcttattctaagacagtctgtccattgagaatattagatttctgacttgcaaatatgtttgtactccagaagaattagaggaaaagcagatactagaattctaatttaattacatatacagccgtctttgtttatagtgtagaattctttatattttgtacaaaaactaattcttttggtaaaatgaaccatttacagttcggttttggactctgagtcaaaggattttcctttaaatgcttgtctcaattttagtctggtcttttgtacttttcttcagaagaaatgaattaaagggtacagttgcataaagtgggtttttatcctaatgtattggaaataaatgataaacttta

SEQ ID NO: 29621 - DNA, 5116 bp, Homo sapiens
ggcccgagccaccgactgcaggaggagaaggggttgtgctcctggccgaggaaggagaaaggggcggggccggcgggcagcgtgcggcagtgcggagctcctgagaccggcgggcacacgggggtctgtggcccccgccgtagcagtggctgccgccgtcgcttggttcccgtcggtctgcgggaggcgggttatggcggcggcggcagtgagagctgtgaatgaattctccgggtggacgagggaagaagaaaggctccggcggcgccagcaacccggtgcctcccaggcctccgcccccttgcctggcccccgcccctcccgccgccgggccggcccctccgcccgagtcgccgcataagcggaacctgtactatttctcctacccgctgtttgtaggcttcgcgctgctgcgtttggtcgccttccacctggggctcctcttcgtgtggctctgccagcgcttctcccgcgccctcatggcagccaagaggagctccggggccgcgccagcacctgcctcggcctcggccccggcgccggtgccgggcggcgaggccgagcgcgtccgagtcttccacaaacaggccttcgagtacatctccattgccctgcgcatcgatgaggatgagaaagcaggacagaaggagcaagctgtggaatggtataagaaaggtattgaagaactggaaaaaggaatagctgttatagttacaggacaaggtgaacagtgtgaaagagctagacgccttcaagctaaaatgatgactaatttggttatggccaaggaccgcttacaacttctagaaagtggagctgttccaaaaagaaaagaccccttaacacacactagtaattcactgcctcgttcaaaaacagttatgaaaactggatctgcaggcctttcaggccaccatagagcacctagttacagtggtttatccatggtttctggagtgaaacagggatctggtcctgctcctaccactcataagggtactccgaaaacaaataggacaaataaaccttctacccctacaactgctactcgtaagaaaaaagacttgaagaattttaggaatgtggacagcaaccttgctaaccttataatgaatgaaattgtggacaatggaacagctgttaaatttgatgatatagctggtcaagacttggcaaaacaagcattgcaagaaattgttattcttccttctctgaggcctgagttgttcacagggcttagagctcctgccagagggctgttactctttggtccacctgggaatgggaagacaatgctggctaaagcagtagctgcagaatcgaatgcaaccttctttaatataagtgctgcaagtttaacttcaaaatacgtgggagaaggagagaaattggtgagggctctttttgctgtggctcgagaacttcaaccttctataatttttatagatgaagttgatagccttttgtgtgaaagaagagaaggggagcacgatgctagtagacgcctaaaaactgaatttctaatagaatttgatggtgtacagtctgctggagatgacagagtacttgtaatgggtgcaactaataggccacaagagcttgatgaggctgttctcaggcgtttcatcaaacgggtatatgtgtctttaccaaatgaggagacaagactacttttgcttaaaaatctgttatgtaaacaaggaagtccattgacccaaaaagaactagcacaacttgctagaatgactgatggatactcaggaagtgacctaacagctttggcaaaagatgcagcactgggtcctatccgagaactaaaaccagaacaggtgaagaatatgtctgccagtgagatgagaaatattcgattatctgacttcactgaatccttgaaaaaaataaaacgcagcgtcagccctcaaactttagaagcgtacatacgttggaacaaggactttggagataccactgtttaaggaaatacctttgtaaacctgcagaacattttacttaaaagaggaaacacaagatcttcaatgaacgtcatcggctacagaaacagcctaagtttacaggactttttagagtcttacatatttgtgcaccaaacttgaagatgaaccagaaaacagacttaaacaaaatatacaatgcaaatgtaattttttgttgtttaaggccttgccttgatggtcacagttatcccaatggacactaagttagagcacaacaaaacctgattctggtcttctttaccaatataatcataatgtaaataataatttgtatattgtgttgcagatgaaagtattccaggaacagtgaatggtagaagacacaagaacatttgtttgtttgtcttctgatgttttttcttaaaatagtaatttctcctacttttcttttctactgttgtcttaactacaggtgattggaatgccaaacactcttaagtttattttcttttttcgttttataaattcagtgtgccaaatgaaacttttttcctaagtaactgtaataggaaaaagtttattttgagagtttcttcttcataaatctacagacattaaacaattgttgtgttctttttaccttttatttttctattaccttgctaccaaacagtttagatagcaatataatagcaaaaaagcaaatatggtaaaatagagaaggtttgaaggtttgagttactctgtcatataacatgtagatcagtcttcatgtgacctgcagtatttttttttctaatgtatttgtcagaaatctgttgtagactgttaacttcttcctgatggaatttattttctgcaagaattattctgatatttaagagagccaattttaactgctgtgaaaatgtttccagtgcaagagaagggaaatactaggaactaagacatttctaatttattgcttattactttcttaattttacaggataattataagcaagtggaactaccatcttttattcttaataattattaatcccttcaatgaaactttaaaaaaactgaatttttatacatggcatacatttttctagttccttctgcttgctttattaactcaaaagttctagttctagtctgttgatctgccttttgttctcccaaaatgtacagtaattccatttgtttgtataaatatgcctggattttcattataaaaatgtcattgtagggagtagagactcatatcatggccttttaaatattgtaataaaggcaaatagatatttgcccttagtttactggttaaaagtttgtttacagaacttttctctggtgcttaaatgatgctatgtaaaatgtcatgagtggaaagaatatttgtagtagtaacaagaatttttcatttaggaaagatttcttaggttttgaaagaatacattaaaataaaaaacttgcccctactaggtaagaactttataatgaagacatacattcttcttaattttactcttgctcttgttaaagatttgtttgaatatagaagatgcatgatttctgggtttttttttttttttgagacagagtttcgctcttgttgcccaggctggagtgcaatggcgcaatctcgactcaccacaacctccgcctcccaggttcaagcaattctcctgcctcagcctcccgagtagctgggattacaggcatgcgccactaccccagctaattttgtatttttagtagagatggggtttctccatgttggtcaggctggtcttgaactcctgacctcaggtgatccgcctgcctcggcctcccaaagtgctgggattacaggcataagccactgcgcccagccagaagatgcatgatttcttaggatcatatgctgtttgtagccataaggtaaatcatgtctcttccaatcatgactttggaactccctgaataataaaaatgagagttgagataaataggggaaaaaaaatttttttcaagccagagctatgcatatgttaggtgatgggtagtatccctttaaggtctcaaacattacaacatcaattatgaaatactgataacgaaaggtagtaatgaaatatatatgatgaaaagaattgagaagttctaaattaagacatttcagttaagctcataaaatttcattgttttcatttaaaagattaacgttattgatacttggataactggctaatcatattaaaggactatgtggttccagctcaacttttaatatattgtctcctttaaaactatcatggttataattctattgggaaagacttttagataacaaagatttcaaatgttaaaagagataaaagtcaggttaatactatcttaaacactgagtcagaaaatcattactgtatagaagttgctttcctgatcaagtctgaacttcagctagtgctagagaactattttctatgacttaactctaaccaagttttattttaagctgtttctttgatagaagggccatgaaaatagagtaatgatatagtaggagataagggattggtttggtctttttcaataaagatagaagttgctgaagttttctgaattaataatgacttagattgtgaccttttagattcggtgttgagctctgtgttgtattacttcctaaaagataatgcttaaacattaagcattagtgtgctcttcatgttaatatggcagagttttgtaaactaaattaaaacttactgatatattggactttgagccaagggaaagaatgagtactatctttccagatatcttaagggtaaaagcttattctaagacagtctgtccattgagaatattagatttctgacttgcaaatatgtttgtactccagaagaattagaggaaaagcagatactagaattctaatttaattacatatacagccgtctttgtttatagtgtagaattctttatattttgtacaaaaactaattcttttggtaaaatgaaccatttacagttcggttttggactctgagtcaaaggattttcctttaaatgcttgtctcaattttagtctggtcttttgtacttttcttcagaagaaatgaattaaagggtacagttgcataaagtgggtttttatcctaatgtattggaaataaatgataaacttt

SEQ ID NO: 29622 - DNA, 27745 bp, Homo sapiens
cccgggcagtggaaaccgtgggcaaaagttagctggcaggacagcgcagctcctccaggcagcggaggcagcgcgtcccggctctcagggacatttccttcccacctcgacccccgggaggtggtcccggtataaaggctcgctgagcgggtgggtcacagcacagctttgcagctgcggagaaacgcccaaggccgtgcatctccaggagggcggctgggctcccgcagtcctgcagaccgcgcccgatcccggcgacagggcgggcggacagccgcgcatccccggggtcccgccgagcctgggcgcagagagccgggaggaagcgttcgctcgcttcgccttgctgctgggaaactgaacgaggccgagagagaaggttcttgagttcatgtaagaggacagtcttaaaacggaagaagaaaaagaagcagttcagtctttgggagagctgcctccttgttgagtgctgcaaaggcctggaattcatttatgacagaatagatctagaaaagtccaagcatgttttctagagtggtgtagccctgtgctgcctccagtgaagagtctcttggtgttggcttcgtgcttccggagggaccatggcaacctccagaggggcctcccggtgtcctcgggatatcgccaatgtgatgcagaggctgcaagatgagcaagagatagtacaaaaacgaactttcacaaaatggatcaactctcatctggccaagcggaaacctccaatggtggtggacgatctttttgaagacatgaaagatggtgttaaactgcttgcccttctggaggtcctgtctgggcagaaactgccttgtgaacaaggacgccggatgaagcgaatccatgctgtggctaacattggcacggcactcaagttcctcgaaggaagaaagattaaattagtcaacattaactccaccgatatagctgatggccgaccctcaatagttcttggattgatgtggaccattattctatatttccagattgaagagttgaccagcaacctgccccagctccagtctttgtccagcagcgcatcctccgtggacagcatagttagctctgagactcccagcccaccaagtaaacggaaggtgaccaccaagatccaaggaaatgctaagaaggctttattaaagtgggttcagtacacagctggcaagcagactggaatagaagtaaaagattttgggaagagttggagaagcggggttgcctttcattcagttattcatgccattcgaccggaattggtggacttggagacagtgaaaggcagatccaaccgagaaaatttggaggatgctttcactatcgccgaaacagaactggggatcccaagactgctagatcctgaagacgttgatgtggataaaccagatgagaaatctattatgacctatgtagcccagtttctgaaacattatcctgacatccacaatgcaagcactgatgggcaagaggatgatgaaatacttccaggtttcccatcttttgcaaattctgtacaaaattttaagagagaagacagagtaatttttaaggaaatgaaagtttggatagaacaatttgagagagatttgacaagagcacagatggtggaatcaaatttacaggataaatatcagtcatttaagcacttcagagttcaatatgaaatgaagaggaaacagattgaacatttaatacaaccattacacagagacggtaaattgtcacttgaccaagcattggtaaaacaatcttgggatagagtgacctccaggctctttgactggcatatacagcttgataaatctcttcctgcacctctgggcaccataggtgcctggctgtacagagcggaggtggccctgagagaggaaataaccgttcaacaggtccacgaggaaacagcaaacacgatacaacggaaacttgagcaacataaggatctgcttcaaaacacggatgcccacaaaagagcattccatgaaatctaccggaccaggtctgttaacgggattccagtgccacctgatcaattagaggacatggccgagaggtttcattttgtttcctccacatcagagctacacctaatgaaaatggaatttttagaattaaagtaccgtctgctctcactgctggttcttgcagagtcaaagctgaagtcttggatcattaagtacgggaggagagagtcagtggagcagcttctacaaaactacgtgtcttttatagaaaatagcaagttctttgaacaatatgaggtgacataccagatcttgaaacagacagctgagatgtatgtcaaagcagatggttcagtggaagaagctgagaatgtgatgaaattcatgaatgaaaccaccgctcagtggaggaatctctcagtagaagtgaggagtgtgaggagcatgctggaagaagtgatctctaactgggatcgctatggcaatacagtggctagtctgcaagcctggctagaggatgctgaaaaaatgctcaatcaatcagaaaatgccaaaaaggatttttttcgaaatttacctcattggattcagcagcatactgccatgaacgatgctggcaattttctaattgaaacctgtgatgagatggtttcccgtgacctgaagcagcaattactgttgctaaatgggcggtggagggagttgtttatggaagtcaagcaatatgctcaagctgatgagatggacagaatgaagaaggaatacacagactgtgttgttaccctgtctgcttttgcaacggaagcccataagaaactttctgaacccttagaagtctcttttatgaatgtcaagctattaattcaagacttggaggatattgagcagagggtgcctgtgatggatgcccaatacaagataattacaaagacagcacacctcattaccaaagaaagcccccaagaagaaggaaaagaaatgtttgcgaccatgtcaaagctcaaagagcagctaaccaaggtcaaagaatgttactccccactcctttatgagtctcagcagctgttgattccgttggaggaattagaaaagcagatgacgtccttttatgactcacttgggaaaatcaatgaaattatcacagttcttgagcgtgaggcacaatcgagtgccctttttaaacaaaaacatcaggaactgttagcttgtcaagaaaactgtaagaaaaccttgacacttattgagaaaggcagtcaaagtgttcaaaagtttgtgaccttgagcaacgtgttaaagcattttgatcagacgaggctacaaagacagattgcagatattcatgttgcttttcagagtatggtaaagaaaactggagattggaagaagcatgtggaaaccaacagtcgcttgatgaagaagtttgaggagtctcgagcagagttggagaaggtactgcggattgctcaggagggcctggaggaaaagggggatccagaggagctcctgcggagacacactgagtttttcagtcagctggatcagagggtgctcaatgctttcctgaaagcttgtgatgaactcaccgacatccttccagagcaggagcagcaggggctgcaggaagctgttcgaaagctccacaaacaatggaaggatcttcaaggagaagccccttatcatttgcttcatctgaagattgatgtggagaagaataggttcttagcctctgtagaagaatgcagaactgagctggatcgagagaccaagctgatgccccaggaaggcagtgaaaagataattaaagagcacagggttttcttcagtgacaaaggtcctcatcatctctgtgagaaaaggttacagctcatcgaggaactctgtgtgaaactcccagtgcgggacccagtaagggacacacctggaacctgtcacgtgactctcaaagagctcagagctgccattgacagcacctacaggaagctcatggaagacccagacaagtggaaggactacactagcagattctctgagttctcatcttggatatctacaaatgagacacaattaaaggggatcaagggtgaggccatcgatactgccaaccacggagaggttaaacgtgccgttgaagagatcagaaatggtgttaccaaaaggggtgagaccctcagctggctgaaatccaggctgaaagttttgacagaagtttcttctgagaatgaagcccaaaagcagggagatgagctggcaaaattatccagctctttcaaggctcttgtgacgctgctgtcagaggttgaaaagatgctaagcaattttggggactgtgtccagtacaaagaaatagtcaaaaattctctcgaagaattaatttctggctctaaagaagtccaggaacaagctgagaagatcttggatactgaaaatctgtttgaagcacagcagttacttcttcatcaccagcaaaagacaaagcggatctcagcaaagaagagagatgtgcagcagcagatcgcgcaggcgcagcagggagaaggggggctgcctgaccgaggccacgaggagctgcggaagctggagagcacactggatggcctggagcgcagccgggagaggcaggaacgccgcatccaggtcacattaagaaaatgggagcgatttgaaacaaacaaagaaacagtagtaagatacctttttcaaacaggttccagtcatgaacgcttcttgagttttagcagtttggaaagtttatcttcagaactggaacaaacaaaggagttttctaaacggacagaaagtattgcagtccaggctgagaaccttgtaaaggaagcttcagagataccgcttgggccccaaaataagcagctgcttcaacagcaggccaagtcaatcaaagaacaagtcaaaaaattagaagacacgcttgaagaagatattaaaaccatggaaatggtgaaaaccaagtgggatcattttggcagtaattttgagactctgtccgtctggataactgagaaagaaaaagaactcaatgccttggaaacttcgtcatctgccatggacatgcaaatcagccaaattaaggtcacaattcaggaaatagaaagtaagctcagcagcattgtaggattagaagaagaagcccagtcttttgctcagtttgttaccactggagaatctgctcgaattaaagccaagttgacacaaataagaagatacggggaagagcttcgagagcatgcacagtgtctggaaggaacaatcctgggacatttatctcagcagcaaaagtttgaagagaaccttagaaagatccagcaatctgtgtctgaatttgaagataaacttgctgttccaattaaaatatgttcttcagctacagaaacatacaaagttcttcaagaacatatggatctctgccaggccctggagtcactgagcagcgcgatcactgccttctcagccagtgccaggaaggttgtgaacagagattcctgtgttcaggaggctgcggctctacagcagcaatacgaggacatcctaaggagggcgaaggagagacagacggcgctggagaatctgctggcccactggcagaggctagagaaagaactatcatcctttttgacctggttagagcggggtgaagctaaagccagttccccagaaatggacatttctgcagacagagtcaaagtggaaggtgaacttcagttaatacaggcactgcaaaatgaagttgtatcccaggcctcattctatagcaaacttttgcaattgaaggaatcattgttctcagtagcctccaaagatgatgtgaaaatgatgaaactacatttggagcagttggatgagagatggagagatttaccacagatcattaacaaaaggattaattttcttcagtctgtggttgctgaacaccagcaatttgatgagctgctgctttccttttctgtctggattaaactgtttctcagtgaattacaaactacctctgagattagcataatggaccatcaagtagcccttactcggcataaggaccacgcagcagaagtagagagcaaaaagggcgaattgcagagtctgcagggtcacttagcaaagttgggttctctgggccgtgctgaggacctccacctcctgcagggaaaggctgaggactgcttccagctgtttgaggaggccagccaggttgtggagaggcggcagcttgccctgtcccatttggcagaattcctccagagccatgcctctctgtccggcattctccgccagctgaggcaaacagtggaagcaaccaacagtatgaataagaacgagtctgatttgatagaaaaggacctcaatgatgctcttcaaaatgctaaagcattagaatctgctgccgtcagtctggatggcattctttccaaagcccaataccatctgaaaatcgggagctctgagcaaaggacttcctgcagagccacggctgatcagctctgtggagaggtagagaggatccagaaccttctgggaaccaagcagagtgaggcagatgctctggcagtgttgaaaaaagcattccaagaccagaaagaggagcttctgaaaagcattgaggacattgaagaaaggactgacaaagagcgattgaaagaacctacccgccaagctcttcagcagaggttaagagtgtttaatcagctagaagatgaattgaattctcacgagcatgaactatgttggttgaaagacaaagccaagcaaattgcccagaaagatgtagcttttgcacctgaagttgacagggagataaaccgcttagaggtcacctgggatgataccaaaagactaattcatgaaaatcagggtcagtgctgtggacttattgacttaatgagagaatatcagaacctgaaatcagctgtatctaaagtcttagaaaatgccagcagtgtgattgtaaccagaactaccataaaagatcaggaggatcttaaatgggctttttccaagcatgaaactgccaagaacaaaatgaattacaaacagaaagacttggataactttaccagcaaaggaaaacacttgttatctgagctgaagaaaattcacagtagtgatttcagcttggtgaaaacagacatggagagcaccgtggacaaatggctggatgtatcagagaaacttgaagaaaacatggataggctgagagtaagcctgtccatttgggatgatgtactgtcaactagagatgagattgagggatggtcaaacaactgcgttccacagatggcagaaaacatcagcaacctggataaccacctcagagctgaagaactgcttaaagaatttgagtctgaagttaaaaacaaagcattgagattggaagaactgcattccaaagttaatgatctgaaagaattaactaaaaatctagaaacaccgccagaccttcagtttatagaagcagacttaatgcagaaactggagcatgccaaagaaataactgaagtagcaaaaggaaccctgaaggatttcacggctcaaagtacacaagtggagaagtttattaatgacataacaacatggttcacaaaagtggaagaatcgttgatgaactgtgcccaaaatgagacttgtgaagcattgaaaaaagtcaaggatatacaaaaagaacttcaaagtcaacaaagcaacatcagctctacccaagaaaatctcaatagcttgtgccgcaagtaccactcagctgagttggagagcctgggccgtgcaatgactggtctgataaagaaacatgaagccgtgagccagttgtgctccaaaacccaggccagcctgcaggaatctctggaaaaacacttcagtgagtctatgcaggaattccaagaatggtttttgggagcaaaggcagcagcaaaagaatcatcagatcgcaccggtgacagcaaagttctagaagcaaagctccatgatcttcagaacattttggactcagtcagtgatgggcagagcaaacttgatgcagtgactcaagaaggacaaactttgtatgcacatttgtctaaacaaattgtcagtagcattcaagaacaaatcacaaaggccaatgaagagtttcaagcatttctgaaacaatgccttaaagataagcaggctcttcaagactgtgcttcagaacttggaagctttgaagatcagcacagaaaactgaacttatggatccatgaaatggaagaaaggttcaatacggaaaacttgggagagagtaaacagcacattcctgagaagaaaaatgaagttcataaagttgaaatgtttttgggagaactgctggctgcaagagagtctcttgataagctttcccagagagggcagcttctgagtgaagaaggccacggtgctgggcaggagggccgcctgtgttcccagctcctcacaagccaccagaacctacttagaatgaccaaagagaaactccggagctgccaggtggcccttcaggagcacgaagccctggaggaagcactgcaaagcatgtggttctgggtgaaggccattcaggacagactggcctgtgcagagagcactcttgggagcaaagacaccctggagaaacggctgtcacaaatacaggatattctcctgatgaaaggtgaaggggaagttaagttgaatatggccattggcaagggggaacaggccttgagaagtagcaacaaagaaggtcagagggtgattcagactcagttagagacccttaaagaagtgtgggctgacatcatgagctcctccgtccacgctcaaagcactttagagtctgtgattagccaatggaatgactatgtagagaggaaaaaccagttggagcagtggatggaatcagtggatcaaaaaatagaacatcccttacaaccacagccaggtctgaaagagaagttcgtcctgcttgaccacctccagtccatcctgtctgaggcagaagatcacacgagagcccttcaccgtctaattgcgaagtccagggagctctacgaaaagacagaggatgagtctttcaaggacacagctcaagaggagctgaaaacacagtttaatgatataatgactgttgccaaggaaaaaatgaggaaagtggaagagattgtgaaagatcatctaatgtatttagatgcggtccacgagttcacagattggctccattcagcaaaggaagaacttcaccggtggtcagatatgtctggagattcatcagccacccagaaaaagttatcaaaaattaaggagctgatagattccagagagattggtgcaagccgtctcagcagagtggagtcgctggctcccgaagtgaaacagaacacaactgccagtgggtgtgagctcatgcacacggagatgcaggccctgcgtgccgactggaagcagtgggaagacagtgtattccaaacgcagagctgtttggagaacctggtcagccagatggccctttcggagcaggaattctcaggccaagtggctcaactggagcaggccctggaacagttcagtgcccttctgaaaacctgggctcagcagttaaccctcctggaaggcaagaacacggatgaggagatagtggaatgctggcacaaaggacaagagatactggatgctttgcaaaaagcagagcctagaacagaggatctcaagtctcagctgaatgaactttgtcgattttccagagacctgagtacctacagtggaaaagtttctggcttgattaaagagtataattgtctttgtttgcaagcatccaagggctgccagaataaagaacagattttacagcaaagatttcgaaaggccttcagggatttccagcagtggttggttaatgcaaaaatcactaccgccaagtgttttgatatacctcaaaatataagtgaagtttcaactagtcttcagaaaatacaggagtttttgtcagaaagtgaaaatggacagcacaagctaaacatgatgctgtctaaaggggaacttctgagtaccctgctgaccaaagagaaagcgaaagggatccaggccaaagttacagctgcaaaagaagattggaaaaattttcattcaaatctccaccaaaaagaatctgctctagagaatctaaagatccaaatgaaggactttgaagtaagtgctgagcctatccaggactggctgagtaaaactgagaagatggtccatgaaagcagcaatcgcctctatgatctgccagcaaagaggagggagcagcagaagctccagtctgtccttgaggaaatacactgctacgagcctcagctcaacaggctgaaagagaaagctcagcagctgtgggaaggacaagctgccagcaagagctttaggcacagagtgtcgcagctgtcttctcagtatctagcgctaagcaatttaacaaaggagaaagtgtcaagactggatagaatcgttgcagaacacaatcagttctctcttgggattaaagaattacaagactggatgacggatgcgattcacatgctggattcatactgccacccgacatccgacaaaagtgtgctggacagcaggacgctcaagctcgaggctctattatcagtcaaacaggaaaaagagattcagatgaaaatgatagtgaccaggggagaatctgtccttcagaatacttctccagaaggcattcccactattcagcagcagctgcagagtgtgaaggatatgtgggcatcccttttgtctgcagggattcgttgtaaaagccaactcgaaggagctctctccaagtggacaagttatcaggatggcgttcgacagttctccggttggatggatagtatggaagccaacctgaatgaatcagaaaggcagcatgcggagctgcgggataaaacaacgatgctcggaaaagccaagttattaaatgaagaagtgctgagttacagcagcttgctggagaccatcgaagtcaaaggggctggcatgacagaacactatgtcacccagctagaactccaggatctacaggaacgatacagagccatccaagagagggccaaggaagccgtaaccaagtctgaaaaacttgtccgcctgcaccaagagtatcagagagacctaaaggcatttgaagtttggttggggcaagaacaagaaaagctcgaccagtattcagttcttgaaggtgatgcccacactcatgagacaacattgcgtgatcttcaggagctacaggtacactgtgcagaggggcaggccctgttgaactcagtgctgcacaccagagaggatgtgatcccatcaggtatcccacaggcagaggaccgggctttagagtctctccggcaagactggcaggcttaccagcacaggctgtccgagactcgaactcagttcaataacgtggtgaacaaattgaggctaatggagcaaaagtttcagcaagtagatgaatggctcaaaacagcagaggagaaagttagtcccaggaccagacgtcagtctaacagggcaaccaaggagatacaattacatcagatgaagaagtggcacgaagaagtgactgcatacagagatgaagttgaggaagtgggagctagagctcaggagatactggacgagagccacgtgaacagcagaatgggttgccaggccacccagctgacttccagataccaggccctgcttctccaagtgctggaacaaataaaattcctggaggaggagattcagagtttggaggaatcagaatcatccctcagttcctattctgattggtatggctctactcataaaaacttcaagaatgtggctaccaagattgacaaagtagatacagtaatgatggggaagaaattgaagacgttggaggttttgctcaaagacatggagaaaggtcacagtttgctgaaatcagcccgggagaaaggagagagggctgttaaatacttggaggaaggcgaggcagagaggttaagaaaggagattcatgatcacatggagcagttgaaggaactgaccagcactgtccggaaagaacacatgacgctggaaaaaggtcttcatttagcaaaggaattctcagataaatgcaaagcactgacacagtggatagcagaataccaggaaattctacatgttcctgaagaacccaaaatggaattatatgagaaaaaagctcagttatctaaatacaagtcacttcaacaaacggtgctgtcccatgaaccatcagtaaagtcagtgagagagaagggtgaagctcttttggaactggtgcaggacgtcactttaaaggacaaaatagatcaacttcaaagtgattaccaggacctgtgcagcataggaaaggagcatgtcttcagtctggaggcgaaagtcaaagaccatgaagactacaacagtgagctccaagaggtcgaaaagtggctgctgcagatgtctggcagactggtggcacctgacctcctggagacaagcagcctggagacaatcacccagcaattggcccaccacaaggcaatgatggaagaaattgctggttttgaagaccgtttgaacaatcttcaaatgaaaggtgatactttgattggccaatgtgcagaccacctgcaagcgaaacttaaacaaaacgtgcatgctcatctgcagggcacaaaggacagctactcagcgatctgcagcacagctcagaggatgtaccagagtttggaacacgaacttcagaagcacgtcagccgacaagacaccctgcagcagtgccaggcctggctttctgcagtccagccggatttagagccaagtcctcaaccacctcttagtagggcagaagccattaagcaggtcaaacacttcagagctttgcaagagcaggcaaggacctacctagatctcctttgctccatgtgtgacctgtcaaatgcttcggtgaaaaccacagcaaaagacattcaacaaacagagcaaacgattgaacaaaagcttgtccaggcccagaacttaactcagggctgggaagagatcaagcacctgaagtctgagctctggatttacctgcaagatgctgatcagcaactgcagaacatgaagaggaggcactctgagctggagctgaacattgcacagaacatggtttcacaagttaaggattttgttaagaaactacagagcaaacaggcatccgtgaacaccataatagaaaaggtgaataagttaacaaagaaggaggaatcgcctgaacacaaggaaataaatcatttaaatgatcagtggctcgatttgtgccgtcagtctaacaacctgtgcttgcaaagggaagaggatcttcagagaacaagagattaccatgactgtatgaatgttgttgaagtgttcctagaaaaatttactacagaatgggataacttggccagatctgatgcagagagtacagctgtccacctggaagctttgaaaaagttagcattggcattgcaggagagaaagtatgctattgaagatctgaaagatcaaaagcagaaaatgatagagcatctgaatttagatgacaaggagttagtcaaagaacagacgagtcatttagagcaacgttggtttcagcttgaggacctcattaaaaggaaaatccaagtgtcagtcaccaacttggaggagttaaatgtggtgcagtccagatttcaggagctaatggagtgggcagaagagcaacaacccaacatcgccgaggcccttaagcagagccctcctccagatatggctcagaaccttctcatggatcacctggccatctgcagtgaactggaggccaagcagatgctcctgaaatcgcttataaaggacgcagacagggtcatggcagatcttggtctcaatgagcgacaggtcatccagaaggctctctctgatgcacaaagccacgtgaattgtctcagtgacttagtgggccagcgaagaaagtacttaaacaaagccttgtccgagaaaacccagtttctcatggcagtgttccaggccaccagccaaattcagcaacatgagcgaaagataatgttccgtgaacacatctgtctgttaccagatgatgtgagcaaacaagtcaaaacatgtaagagtgcacaagccagcctcaagacttaccaaaatgaagtcactggactttgggcccagggtcgcgaactaatgaaggaagtcacagagcaggaaaagagtgaagtgctggggaagcttcaggaattgcagagtgtctatgacagtgttttacaaaagtgcagtcaccggttacaagaactagagaagaatttggtttctaggaagcattttaaggaagattttgataaagcttgccactggctaaaacaagcagatattgttacatttcctgaaatcaacctaatgaatgagagttctgagcttcatacacaactggctaaataccaaaacattcttgaacaatctccagaatatgaaaatcttctacttacgctgcagagaactgggcagaccatattaccatcgctgaatgaagtcgatcattcctacctcagtgaaaagctaaatgctttgcctcgacaatttaatgtaattgttgccttggctaaagacaagttctataaagtccaggaagcaattcttgctcggaaggaatatgcttccttgattgagttgacaacccagtctctgagtgaacttgaagcccaattcttgaggatgagcaaagttcccaccgacctggccgttgaggaggctctttctctgcaagatggttgcagagccattctggacgaggtggcgggccttggggaggcggtggatgaactgaaccagaaaaaagaaggttttcgcagcacaggtcagccttggcagccagacaagatgctgcaccttgtcaccttatatcacaggctgaagcgacaaacagaacagagggttagcttattagaagacaccaccagtgcttaccaagaacacgagaagatgtgccaacagctggagagacaactgaagtctgtaaaagaggagcagtccaaagtgaatgaggaaacgctgcctgcagaggagaagctcaaaatgtatcactccctggcaggaagtctccaggactcagggattgtactgaaacgagtaaccatacatcttgaagatcttgccccacaccttgaccccttggcttatgagaaagccaggcatcagatccagtcctggcaaggggagttaaaactgttgacttctgccattggtgagacggtgacagaatgtgagagccgaatggtgcagagtatagacttccagactgagatgagtcgctccctggactggctgaggagagtgaaggcagagctcagtgggccggtgtacctagacctcaacctgcaggacatccaagaggaaatcagaaaaatccaaattcatcaggaagaggtccagtccagcttgagaatcatgaatgcgctgagtcacaaggaaaaggagaagttcacaaaggccaaggagctgatttctgcggatttagaacacagcctcgctgagctctcagagctggatggagacatccaggaagccttacgcaccagacaggctaccttgactgaaatatatagccagtgtcaaaggtattatcaggtatttcaagcagccaatgactggcttgaggatgcccaagaattgttacagctggcaggcaatggcctagacgtggagagcgcagaggaaaatctcaaaagccacatggaatttttcagtacagaggatcagttccatagtaacctggaggagctccacagcctggtagccaccctggacccactcatcaagccaaccggcaaagaagacctagaacagaaagtggcttctctggaactcaggagccagaggatgagccgggactctggtgcccaagtggatctcttgcagagatgcacagctcaatggcacgattaccagaaagcaagggaagaggttattgaattgatgaatgatacagaaaagaaattgtctgagttttctttgttgaagacttcgtctagtcatgaagcggaagaaaaattgtcagaacacaaggctttagtgtcagtggttaactctttccatgagaaaattgtggcccttgaggaaaaagcttcacaactggagaaaaccggaaatgatgccagcaaagccaccctgagcaggtcaatgaccaccgtctggcagcgctggacacgccttcgagctgtggcccaggaccaggagaagatcctggaagatgcagtggatgagtggacgggctttaacaacaaggttaaaaaggccactgaaatgattgatcagctgcaagataagttacctggaagttcagcagagaaagcatcgaaagcagagctcttaactcttcttgaataccacgacacgttcgttctggagctggagcagcagcagtcggccttgggcatgctgcggcagcaaaccctgagcatgctccaggatggagccgccccaacccctggggaagagcctccgctcatgcaggaaatcaccgccatgcaagatcggtgcctgaacatgcaggagaaagtgaagactaatggaaagttggtgaagcaagagctgaaggaccgagaaatggtggagactcagatcaattctgtgaaatgttgggttcaggaaacgaaagaatatttagggaatccaacaatagaaatagatgctcaacttgaagaacttcagattctcctaacagaagccacaaatcaccgacagaacattgaaaaaatggcagaagaacagaaggagaagtacttaggtctttataccatattaccttctgaactctcccttcagttggctgaagtggcgttagatctaaagatccgagatcagatccaagacaaaataaaagaagttgagcagagcaaggccacgagccaggaactcagccggcaaattcagaagttagctaaagacctcacaactattctaactaagctgaaagcgaagacagataatgtagttcaagctaaaactgaccaaaaggtgctgggagaggaattagatggctgtaattcaaagttaatggaattagatgcagcagtacagaaattcttggaacagaatggccaactgggtaagccactggccaagaagataggaaaactgactgaacttcaccagcagaccattagacaagctgagaatcggctctccaagctcaatcaggcagcatcacatttagaagaatacaatgaaatgcttgaattaattttgaagtggattgaaaaagctaaagtcttggctcatggaactattgcatggaattctgcaagccagcttcgggaacaatatattttgcatcagaccctgctagaagaatccaaagaaattgacagtgagctggaagcaatgactgagaaattacagtacctcactagcgtgtactgtacagaaaaaatgtctcagcaagtggcagaactgggacgggagactgaggagttgcgacagatgatcaaaattcgtttgcagaacctccaagatgcagctaaggatatgaaaaaatttgaagcagagttgaaaaagttacaagctgccttggagcaagcccaggcaacactgacttctccagaagttggacgtctcagtctcaaggagcagctctctcatcggcagcatttgttgtctgagatggagtcactgaagccgaaggtgcaagcagtgcagctctgccagagtgccctccggatccccgaggatgtggttgccagcttacctctctgtcatgctgctctgcggctgcaggaagaggccagccggctgcagcacaccgccatccagcagtgtaacatcatgcaggcagctgtggtacaatatgaacaatatgagcaagaaatgaaacatctccagcaactgatagaaggagctcacagagagattgaggataaacctgttgccaccagtaacatacaggagctgcaggctcagatttctcggcatgaggagctggcgcagaaaattaagggctaccaggagcagatcgcttctttgaattccaagtgcaagatgctgacgatgaaagccaagcacgccaccatgctgctgacggtgaccgaggtcgaggggctggcggaagggacagaggacctggatggggagctcctccccacgccttcggcccacccctctgtggtcatgatgactgcaggtcgctgtcacactttgctgtcaccggtcactgaggagtctggggaggagggaaccaacagtgagatttcctctccacctgcctgtcgctccccttcacctgtggctaatacagatgcttctgttaaccaggacattgcatattaccaagccttgtctgctgagaggttgcagacagatgctgcaaaaattcaccccagcacatccgcatcccaggagttctatgaaccgggattggagccatccgctactgccaaactgggtgatttgcagcgttcttgggaaaccttaaagaatgtgatcagtgagaagcagcgcacactctatgaagctttggaacgccagcagaagtaccaggactccctccagtccatctctacgaagatggaggccattgagctgaaactcagtgagagcccagagcctggcaggagtccagaaagccagatggctgaacatcaggcattgatggatgagattctcatgctccaggatgaaatcaatgagctccagtcctctctcgcagaggagctggtatccgagtcttgtgaggccgaccctgcggagcagctggccttgcagtccacgctcactgtcttagccgagcgaatgtccaccatcaggatgaaagcctcggggaaacggcagcttttggaggagaagttgaatgatcagctggaggaacaaaggcaggaacaggccctgcagaggtatcgctgtgaagccgatgagctggacagctggctcttgagtaccaaggccactctggacactgcgctgagtccacccaaggagcccatggacatggaggcccagcttatggactgccagaatatgctggtggaaatagagcagaaggtggtggctttatcagaactgtcagtccacaatgagaacctgctgctggagggcaaagctcacaccaaggacgaggccgagcagctggctggaaagctgagaaggctcaaggggagcctgctggagctgcagagagccctgcatgataagcagctcaacatgcagggaacagcacaggagaaggaggagagcgatgttgacctaacagccacgcagagccccggcgtccaggaatggctggcccaagctcgcaccacatggacccagcagcggcagagcagtctccagcaacaaaaagagttagaacaggaattagccgagcagaagagtctccttcgctcagtagccagtcgtggagaggagattctaattcaacattcggcggcagagacctctggtgatgctggcgaaaaacctgatgtgttatcccaggagttggggatggaaggggagaaatcatccgctgaagaccagatgagaatgaaatgggaaagcctacatcaagaatttagtaccaagcagaaactactacagaatgttctggaacaggaacaagagcaagtgctttatagcaggccaaatcgactcttgtctggtgtgccactgtacaaaggggacgtgccaacccaagataaatctgcagttacatctttgctggatggactgaaccaagccttcgaggaggtttcatcccagagtggaggggcaaagaggcagagtatacacttggagcagaagttgtatgatggagtctcagccacctctacttggttggatgacgttgaagaacgtttatttgttgccacagcacttttaccagaagaaacagagacttgtctcttcaaccaagagattcttgccaaagacattaaggaaatgtctgaagaaatggataagaacaaaaacttgttttcccaagcttttccagagaatggtgataatcgagatgttattgaagatactttgggttgtcttttgggcaggttatccttgctagactcagtagtgaatcaacgatgtcatcagatgaaagaaagacttcagcaaatactaaatttccagaatgatctgaaagtgctgtttacatcactggctgacaacaaatacatcattctgcaaaaactggcaaatgtgtttgaacagcccgtagcagaacaaatagaggcaatacaacaggctgaagatggactcaaagaatttgatgcaggaatcattgaattaaagaggcgtggtgacaagctacaggtcgagcagccgtccatgcaagaactctccaagctccaggacatgtatgatgagctgatgatgatcattggctcccggaggagtggtctgaatcagaaccttacactcaagagtcagtatgagagggccctacaagatctggctgacctgctagaaactggtcaggagaagatggcaggagaccagaaaatcatcgtgtcttccaaagaggaaatccagcaactacttgacaaacataaggaatactttcagggcctggaatctcatatgatcttgactgaaacactcttcagaaagataatcagctttgcagtccaaaaggaaacccagttccatacagagctgatggctcaggcttctgctgtactgaaacgggctcacaagaggggtgtggagctggagtacattctagagacgtggtcccatctggatgaggaccagcaggagctcagcagacagctggaggtggtggaaagcagcatcccaagcgtgggtctggtggaggagaacgaggacaggcttattgaccgcataacactctaccagcatttaaaatctagccttaatgaataccagcccaaattatatcaagtattagatgatgggaaacgacttctgatatccatcagctgctcagatctagaaagccaactaaatcaacttggagagtgctggctaagtaacaccaataaaatgtctaaggaacttcacagactggaaacaatattgaaacactggaccagatatcaaagtgaatctgcagatctaattcactggttacaatctgcaaaagaccggctagaattttggactcagcaatctgtgacagtcccacaagagctggaaatggtccgtgatcatctaaatgctttcctggagttttctaaagaagtggatgcccaatcttccctgaaatcatctgttctgagtactggaaatcagctccttcgactaaaaaaggtggacacagccacgctgcgctctgagctgtcgcgcattgatagccagtggactgacctgctaaccaatatcccagccgtccaggagaagctccaccagctccagatggataaactgccttcccgccatgccatttctgaagtcatgagttggatttctctaatggaaaatgttattcagaaggatgaagataatattaaaaattccataggttacaaggcaattcatgaataccttcagaaatataagggttttaagatagacattaactgtaaacagctgacagtggattttgtgaaccagtccgtgctacaaatcagcagtcaggatgtggaaagtaagcgtagtgataagactgattttgctgagcaacttggagcaatgaataaaagttggcaaattctgcaaggtctagtaactgagaagatccagctgttggaaggcttattggaatcttggtcagaatatgaaaataatgtacaatgtctgaaaacatggtttgaaacccaggaaaagagactaaaacaacagcatcgaattggagatcaggcttctgttcaaaatgcactgaaagactgtcaggatctggaagatttgattaaagcaaaagaaaaagaagtagagaaaattgagcagaatggacttgctttgattcagaacaagaaagaagacgtctctagcattgtcatgagcacactgcgagagctcggccaaacctgggcaaatttagatcacatggttggacaattaaagatactgctgaaatcagtgcttgaccaatggagtagtcacaaagtggcctttgacaagataaacagttacctcatggaggccagatactctctttcccgattccgtctgctgactggctccttagaagctgtgcaagttcaggtggacaatcttcagaatctccaagatgatctggaaaaacaggaaaggagcttacagaaatttggctctatcaccaaccaattattaaaagagtgtcacccacccgtgacagaaactcttaccaatacactgaaagaagtcaacatgagatggaataacttgctggaagagattgctgagcagctacagtccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgacctcctcaaaggactgggcacagttaaagattccctcttttttctccatgagctgggagagcaactgaagcaacaagtggatgcttccgcagcatcagctattcaatcggatcaactctctttgagtcaacacttgtgtgccctggagcaagctctctgcaaacagcagacttcattacaggctggagttcttgattatgaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaaatgagcttggatataggttacccttgaatgataaggaaatcaaaagaatgcagaatctgaaccgccattggtctctgatctcctctcagactacagaaagattcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgagttgtttcaagccgagatgttcagtcgtcagcagattttgcactcaatcattattgatgggcaacgtcttctagaacaaggtcaagttgatgacagggatgaattcaacctgaaattgacactcctcagtaatcaatggcagggagtgattcgcagggcccagcagaggcgggggatcattgacagccagattcgccagtggcagcgctatagggagatggcagaaaagcttcgtaaatggttggttgaagtgtcctacctccccatgagtggtctcggaagtgttcctataccactgcaacaagcaaggaccctctttgatgaagtgcagttcaaagaaaaagtgtttctgcggcaacaaggcagctacatcctgactgtggaggctggcaagcaactccttctctcggcggacagtggcgctgaggccgccttgcaggccgaactcgctgaaatccaagagaaatggaaatcagccagcatgcggctggaagaacagaagaaaaaactagccttcttgttgaaagactgggaaaaatgtgagaaaggaatagcagattccctggagaaactacgaactttcaaaaagaagctttcgcagtctctcccggatcaccatgaagagctccatgcagaacaaatgcgttgcaaggaattagaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagcagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttggcttatcaggggaccacagtgccctagagtcacagatccgacaactgggcaaagccctggatgatagccgttttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacgccacgaggcaagtgtagtctctcacagcctggaccctctgtcagcagtccacatagcaggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaaagatatttatgtatgtacagtttgctaaagccaagttttgtttgtattgatttctttgcatttattatagatattataaaata

SEQ ID NO: 29623 - DNA, 26581 bp, Homo sapiens
cccgggcagtggaaaccgtgggcaaaagttagctggcaggacagcgcagctcctccaggcagcggaggcagcgcgtcccggctctcagggacatttccttcccacctcgacccccgggaggtggtcccggtataaaggctcgctgagcgggtgggtcacagcacagctttgcagctgcggagaaacgcccaaggccgtgcatctccaggagggcggctgggctcccgcagtcctgcagaccgcgcccgatcccggcgacagggcgggcggacagccgcgcatccccggggtcccgccgagcctgggcgcagagagccgggaggaagcgttcgctcgcttcgccttgctgctgggaaactgaacgaggccgagagagaaggttcttgagttcatgtaagaggacagtcttaaaacggaagaagaaaaagaagcagttcagtctttgggagagctgcctccttgttgagtgctgcaaaggcctggaattcatttatgacagaatagatctagaaaagtccaagcatgttttctagagtggtgtagccctgtgctgcctccagtgaagagtctcttggtgttggcttcgtgcttccggagggaccatggcaacctccagaggggcctcccggtgtcctcgggatatcgccaatgtgatgcagaggctgcaagatgagcaagagatagtacaaaaacgaactttcacaaaatggatcaactctcatctggccaagcggaaacctccaatggtggtggacgatctttttgaagacatgaaagatggtgttaaactgcttgcccttctggaggtcctgtctgggcagaaactgccttgtgaacaaggacgccggatgaagcgaatccatgctgtggctaacattggcacggcactcaagttcctcgaaggaagaaagattaaattagtcaacattaactccaccgatatagctgatggccgaccctcaatagttcttggattgatgtggaccattattctatatttccagattgaagagttgaccagcaacctgccccagctccagtctttgtccagcagcgcatcctccgtggacagcatagttagctctgagactcccagcccaccaagtaaacggaaggtgaccaccaagatccaaggaaatgctaagaaggctttattaaagtgggttcagtacacagctggcaagcagactggaatagaagtaaaagattttgggaagagttggagaagcggggttgcctttcattcagttattcatgccattcgaccggaattggtggacttggagacagtgaaaggcagatccaaccgagaaaatttggaggatgctttcactatcgccgaaacagaactggggatcccaagactgctagatcctgaagacgttgatgtggataaaccagatgagaaatctattatgacctatgtagcccagtttctgaaacattatcctgacatccacaatgcaagcactgatgggcaagaggatgatgaaatacttccaggtttcccatcttttgcaaattctgtacaaaattttaagagagaagacagagtaatttttaaggaaatgaaagtttggatagaacaatttgagagagatttgacaagagcacagatggtggaatcaaatttacaggataaatatcagtcatttaagcacttcagagttcaatatgaaatgaagaggaaacagattgaacatttaatacaaccattacacagagacggtaaattgtcacttgaccaagcattggtaaaacaatcttgggatagagtgacctccaggctctttgactggcatatacagcttgataaatctcttcctgcacctctgggcaccataggtgcctggctgtacagagcggaggtggccctgagagaggaaataaccgttcaacaggtccacgaggaaacagcaaacacgatacaacggaaacttgagcaacataagagaaaactaaggaatgtaatagatctgcttcaaaacacggatgcccacaaaagagcattccatgaaatctaccggaccaggtctgttaacgggattccagtgccacctgatcaattagaggacatggccgagaggtttcattttgtttcctccacatcagagctacacctaatgaaaatggaatttttagaattaaagtaccgtctgctctcactgctggttcttgcagagtcaaagctgaagtcttggatcattaagtacgggaggagagagtcagtggagcagcttctacaaaactacgtgtcttttatagaaaatagcaagttctttgaacaatatgaggtgacataccagatcttgaaacagacagctgagatgtatgtcaaagcagatggttcagtggaagaagctgagaatgtgatgaaattcatgaatgaaaccaccgctcagtggaggaatctctcagtagaagtgaggagtgtgaggagcatgctggaagaagtgatctctaactgggatcgctatggcaatacagtggctagtctgcaagcctggctagaggatgctgaaaaaatgctcaatcaatcagaaaatgccaaaaaggatttttttcgaaatttacctcattggattcagcagcatactgccatgaacgatgctggcaattttctaattgaaacctgtgatgagatggtttcccgtgacctgaagcagcaattactgttgctaaatgggcggtggagggagttgtttatggaagtcaagcaatatgctcaagctgatgagatggacagaatgaagaaggaatacacagactgtgttgttaccctgtctgcttttgcaacggaagcccataagaaactttctgaacccttagaagtctcttttatgaatgtcaagctattaattcaagacttggaggatattgagcagagggtgcctgtgatggatgcccaatacaagataattacaaagacagcacacctcattaccaaagaaagcccccaagaagaaggaaaagaaatgtttgcgaccatgtcaaagctcaaagagcagctaaccaaggtcaaagaatgttactccccactcctttatgagtctcagcagctgttgattccgttggaggaattagaaaagcagatgacgtccttttatgactcacttgggaaaatcaatgaaattatcacagttcttgagcgtgaggcacaatcgagtgccctttttaaacaaaaacatcagttgaggatactgaaatgcaaatggtgtaattcaagccaaaaaatgaccctctgccttgtgctgggctcaatgatttccatgctgtctactgccaaaatcacaattgcaggctacaagtcagaggtggaggtgtctgaactgttagcttgtcaagaaaactgtaagaaaaccttgacacttattgagaaaggcagtcaaagtgttcaaaagtttgtgaccttgagcaacgtgttaaagcattttgatcagacgaggctacaaacagattgcagatattcatgttgcttttcagtaatgagaaagcagcatcacattatgattgtttttcacatcaagagtatggtaaagaaaactggagattggaagaagcatgtggaaaccaacagtcgcttgatgaagaagtttgaggagtctcgagcagagttggagaaggtactgcggattgctcaggagggcctggaggaaaagggggatccagaggagctcctgcggagacacactgagtttttcagtcagctggatcagagggtgctcaatgctttcctgaaagcttgtgatgaactcaccgacatccttccagagcaggagcagcaggggctgcaggaagctgttcgaaagctccacaaacaatggaaggatcttcaaggagaagccccttatcatttgcttcatctgaagattgatgtggagaagaataggttcttagcctctgtagaagaatgcagaactgagctggatcgagagaccaagctgatgccccaggaaggcagtgaaaagataattaaagagcacagggttttcttcagtgacaaaggtcctcatcatctctgtgagaaaaggttacagctcatcgaggaactctgtgtgaaactcccagtgcgggacccagtaagggacacacctggaacctgtcacgtgactctcaaagagctcagagctgccattgacagcacctacaggaagctcatggaagacccagacaagtggaaggactacactagcagattctctgagttctcatcttggatatctacaaatgagacacaattaaaggggatcaagggtgaggccatcgatactgccaaccacggagaggttaaacgtgccgttgaagagatcagaaatggtgttaccaaaaggggtgagaccctcagctggctgaaatccaggctgaaagttttgacagaagtttcttctgagaatgaagcccaaaagcagggagatgagctggcaaaattatccagctctttcaaggctcttgtgacgctgctgtcagaggttgaaaagatgctaagcaattttggggactgtgtccagtacaaagaaatagtcaaaaattctctcgaagaattaatttctggctctaaagaagtccaggaacaagctgagaagatcttggatactgaaaatctgtttgaagcacagcagttacttcttcatcaccagcaaaagacaaagcggatctcagcaaagaagagagatgtgcagcagcagatcgcgcaggcgcagcagggagaaggggggctgcctgaccgaggccacgaggagctgcggaagctggagagcacactggatggcctggagcgcagccgggagaggcaggaacgccgcatccaggtcacattaagaaaatgggagcgatttgaaacaaacaaagaaacagtagtaagatacctttttcaaacaggttccagtcatgaacgcttcttgagttttagcagtttggaaagtttatcttcagaactggaacaaacaaaggagttttctaaacggacagaaagtattgcagtccaggctgagaaccttgtaaaggaagcttcagagataccgcttgggccccaaaataagcagctgcttcaacagcaggccaagtcaatcaaagaacaagtcaaaaaattagaagacacgcttgaagaagagtatgtgattgacaataaaaccatggaaatggtgaaaaccaagtgggatcattttggcagtaattttgagactctgtccgtctggataactgagaaagaaaaagaactcaatgccttggaaacttcgtcatctgccatggacatgcaaatcagccaaattaaggtcacaattcaggaaatagaaagtaagctcagcagcattgtaggattagaagaagaagcccagtcttttgctcagtttgttaccactggagaatctgctcgaattaaagccaagttgacacaaataagaagatacggggaagagcttcgagagcatgcacagtgtctggaaggaacaatcctgggacatttatctcagcagcaaaagtttgaagagaaccttagaaagatccagcaatctgtgtctgaatttgaagataaacttgctgttccaattaaaatatgttcttcagctacagaaacatacaaagttcttcaagaacatatggatctctgccaggccctggagtcactgagcagcgcgatcactgccttctcagccagtgccaggaaggttgtgaacagagattcctgtgttcaggaggctgcggctctacagcagcaatacgaggacatcctaaggagggcgaaggagagacagacggcgctggagaatctgctggcccactggcagaggctagagaaagaactatcatcctttttgacctggttagagcggggtgaagctaaagccagttccccagaaatggacatttctgcagacagagtcaaagtggaagcctccaaagatgatgtgaaaatgatgaaactacatttggagcagttggatgagagatggagagatttaccacagatcattaacaaaaggattaattttcttcagtctgtggttgctgaacaccagcaatttgatgagctgctgctttccttttctgtctggattaaactgtttctcagtgaattacaaactacctctgagattagcataatggaccatcaagtagcccttactcggcataaggaccacgcagcagaagtagagagcaaaaagggcgaattgcagagtctgcagggtcacttagcaaagttgggttctctgggccgtgctgaggacctccacctcctgcagggaaaggctgaggactgcttccagctgtttgaggaggccagccaggttgtggagaggcggcagcttgccctgtcccatttggcagaattcctccagagccatgcctctctgtccggcattctccgccagctgaggcaaacagtggaagcaaccaacagtatgaataagaacgagtctgatttgatagaaaaggacctcaatgatgctcttcaaaatgctaaagcattagaatctgctgccgtcagtctggatggcattctttccaaagcccaataccatctgaaaatcgggagctctgagcaaaggacttcctgcagagccacggctgatcagctctgtggagaggtagagaggatccagaaccttctgggaaccaagcagagtgaggcagatgctctggcagtgttgaaaaaagcattccaagaccagaaagaggagcttctgaaaagcattgaggacattgaagaaaggactgacaaagagcgattgaaagaacctacccgccaagctcttcagcagaggttaagagtgtttaatcagctagaagatgaattgaattctcacgagcatgaactatgttggttgaaagacaaagccaagcaaattgcccagaaagatgtagcttttgcacctgaagttgacagggagataaaccgcttagaggtcacctgggatgataccaaaagactaattcatgaaaatcagggtcagtgctgtggacttattgacttaatgagagaatatcagaacctgaaatcagctgtatctaaagtcttagaaaatgccagcagtgtgattgtaaccagaactaccataaaagatcaggaggatcttaaatgggctttttccaagcatgaaactgccaagaacaaaatgaattacaaacagaaagacttggataactttaccagcaaaggaaaacacttgttatctgagctgaagaaaattcacagtagtgatttcagcttggtgaaaacagacatggagagcaccgtggacaaatggctggatgtatcagagaaacttgaagaaaacatggataggctgagagtaagcctgtccatttgggatgatgtactgtcaactagagatgagattgagggatggtcaaacaactgcgttccacagatggcagaaaacatcagcaacctggataaccacctcagagctgaagaactgcttaaagaatttgagtctgaagttaaaaacaaagcattgagattggaagaactgcattccaaagttaatgatctgaaagaattaactaaaaatctagaaacaccgccagaccttcagtttatagaagcagacttaatgcagaaactggagcatgccaaagaaataactgaagtagcaaaaggaaccctgaaggatttcacggctcaaagtacacaagtggagaagtttattaatgacataacaacatggttcacaaaagtggaagaatcgttgatgaactgtgcccaaaatgagacttgtgaagcattgaaaaaagtcaaggatatacaaaaagaacttcaaagtcaacaaagcaacatcagctctacccaagaaaatctcaatagcttgtgccgcaagtaccactcagctgagttggagagcctgggccgtgcaatgactggtctgataaagaaacatgaagccgtgagccagttgtgctccaaaacccaggccagcctgcaggaatctctggaaaaacacttcagtgaagagtctatgcaggaattccaagaatggtttttgggagcaaaggcagcagcaaaagaatcatcagatcgcaccggtgacagcaaagttctagaagcaaagctccatgatcttcagcagaacattttggactcagtcagtgatgggcagagcaaacttgatgcagtgactcaagaaggacaaactttgtatgcacatttgtctaaacaaattgtcagtagcattcaagaacaaatcacaaaggccaatgaagagtttcaagcatttctgaaacaatgccttaaagataagcaggctcttcaagactgtgcttcagaacttggaagctttgaagatcagcacagaaaactgaacttatggatccatgaaatggaagaaaggttcaatacggaaaacttgggagagagtaaacagcacattcctgagaagaaaaatgaagttcataaagttgaaatgtttttgggagaactgctggctgcaagagagtctcttgataagctttcccagagagggcagcttctgagtgaagaaggccacggtgctgggcaggagggccgcctgtgttcccagctcctcacaagccaccagaacctacttagaatgaccaaagagaaactccggagctgccaggtggcccttcaggagcacgaagccctggaggaagcactgcaaagcatgtggttctgggtgaaggccattcaggacagactggcctgtgcagagagcactcttgggagcaaagacaccctggagaaacggctgtcacaaatacaggatattctcctgatgaaaggtgaaggggaagttaagttgaatatggccattggcaagggggaacaggccttgagaagtagcaacaaagaaggtcagagggtgattcagactcagttagagacccttaaagaagtgtgggctgacatcatgagctcctccgtccacgctcaaagcactttagagtctgtgattagccaatggaatgactatgtagagaggaaaaaccagttggagcagtggatggaatcagtggatcaaaaaatagaacatcccttacaaccacagccaggtctgaaagagaagttcgtcctgcttgaccacctccagtccatcctgtctgaggcagaagatcacacgagagcccttcaccgtctaattgcgaagtccagggagctctacgaaaagacagaggatgagtctttcaaggacacagctcaagaggagctgaaaacacagtttaatgatataatgactgttgccaaggaaaaaatgaggaaagtggaagagattgtgaaagatcatctaatgtatttagatgcggtccacgagttcacagattggctccattcagcaaaggaagaacttcaccggtggtcagatatgtctggagattcatcagccacccagaaaaagttatcaaaaattaaggagctgatagattccagagagattggtgcaagccgtctcagcagagtggagtcgctggctcccgaagtgaaacagaacacaactgccagtgggtgtgagctcatgcacacggagatgcaggccctgcgtgccgactggaagcagtgggaagacagtgtattccaaacgcagagctgtttggagaacctggtcagccagatggccctttcggagcaggaattctcaggccaagtggctcaactggagcaggccctggaacagttcagtgcccttctgaaaacctgggctcagcagttaaccctcctggaaggcaagaacacggatgaggagatagtggaatgctggcacaaaggacaagagatactggatgctttgcaaaaagcagagcctagaacagaggatctcaagtctcagctgaatgaactttgtcgattttccagagacctgagtacctacagtggaaaagtttctggcttgattaaagagtataattgtctttgtttgcaagcatccaagggctgccagaataaagaacagattttacagcaaagatttcgaaaggccttcagggatttccagcagtggttggttaatgcaaaaatcactaccgccaagtgttttgatatacctcaaaatataagtgaagtttcaactagtcttcagaaaatacaggagtttttgtcagaaagtgaaaatggacagcacaagctaaacatgatgctgtctaaaggggaacttctgagtaccctgctgaccaaagagaaagcgaaagggatccaggccaaagttacagctgcaaaagaagattggaaaaattttcattcaaatctccaccaaaaagaatctgctctagagaatctaaagatccaaatgaaggactttgaagtaagtgctgagcctatccaggactggctgagtaaaactgagaagatggtccatgaaagcagcaatcgcctctatgatctgccagcaaagaggagggagcagcagaagctccagtctgtccttgaggaaatacactgctacgagcctcagctcaacaggctgaaagagaaagctcagcagctgtgggaaggacaagctgccagcaagagctttaggcacagagtgtcgcagctgtcttctcagtatctagcgctaagcaatttaacaaaggagaaagtgtcaagactggatagaatcgttgcagaacacaatcagttctctcttgggattaaagaattacaagactggatgacggatgcgattcacatgctggattcatactgccacccgacatccgacaaaagtgtgctggacagcaggacgctcaagctcgaggctctattatcagtcaaacaggaaaaagagattcagatgaaaatgatagtgaccaggggagaatctgtccttcagaatacttctccagaaggcattcccactattcagcagcagctgcagagtgtgaaggatatgtgggcatcccttttgtctgcagggattcgttgtaaaagggtgaggctcccctgtgcctatattgccctcaaactgagagtacatcagcatgcggagctgcgggataaaacaacgatgctcggaaaagccaaggaagccgtaaccaagtctgaaaaacttgtccgcctgcaccaagagtatcagagagacctaaaggcatttgaagtttggttggggcaagaacaagaaaagctcgaccagtattcagttcttgaaggtgatgcccacactcatgagacaacattgcgtgatcttcaggagctacaggtacactgtgcagaggggcaggccctgttgaactcagtgctgcacaccagagaggatgtgatcccatcaggtatcccacaggcagaggaccgggctttagagtctctccggcaagactggcaggcttaccagcacaggctgtccgagactcgaactcagttcaataacgtggtgaacaaattgaggctaatggagcaaaagtttcagcaagtagatgaatggctcaaaacagcagaggagaaagttagtcccaggaccagacgtcagtctaacagggcaaccaaggagatacaattacatcagatgaagaagtggcacgaagaagtgactgcatacagagatgaagttgaggaagtgggagctagagctcaggagatactggacgagagccacgtgaacagcagaatgggttgccaggccacccagctgacttccagataccaggccctgcttctccaagtgctggaacaaataaaattcctggaggaggagattcagagtttggaggaatcagaatcatccctcagttcctattctgattggtatggctctactcataaaaacttcaagaatgtggctaccaagattgacaaagtagatacagtaatgatggggaagaaattgaagacgttggaggttttgctcaaagacatggagaaaggtcacagtttgctgaaatcagcccgggagaaaggagagagggctgttaaatacttggaggaaggcgaggcagagaggttaagaaaggagattcatgatcacatggagcagttgaaggaactgaccagcactgtccggaaagaacacatgacgctggaaaaatcacttcaacaaacggtgctgtcccatgaaccatcagtaaagtcagtgagagagaagggtgaagctcttttggaactggtgcaggacgtcactttaaaggacaaaatagatcaacttcaaagtgattaccaggacctgtgcagcataggaaaggagcatgtcttcagtctggaggcgaaagtcaaagaccatgaagactacaacagtgagctccaagaggtcgaaaagtggctgctgcagatgtctggcagactggtggcacctgacctcctggagacaagcagcctggagacaatcacccagcaattggcccaccacaagatgtaccagagtttggaacacgaacttcagaagcacgtcagccgacaagacaccctgcagcagtgccaggcctggctttctgcagtccagccggatttagagccaagtcctcaaccacctcttagtagggcagaagccattaagcaggtcaaacacttcagagctttgcaagagcaggcaaggacctacctagatctcctttgctccatgtgtgacctgtcaaatgcttcggtgaaaaccacagcaaaagacattcaacaaacagagcaaacgattgaacaaaagcttgtccaggcccagaacttaactcagggctgggaagagatcaagcacctgaagtctgagctctggatttacctgcaagatgctgatcagcaactgcagaacatgaagaggaggcactctgagctggagctgaacattgcacagaacatggtttcacaagttaaggattttgttaagaaactacagagcaaacaggcatccgtgaacaccataatagaaaaggtgaataagttaacaaagaaggaggaatcgcctgaacacaaggaaataaatcatttaaatgatcagtggctcgatttgtgccgtcagtctaacaacctgtgcttgcaaagggaagaggatcttcagagaacaagagattaccatgactgtatgaatgttgttgaagtgttcctagaaaaatttactacagaatgggataacttggccagatctgatgcagagagtacagctgtccacctggaagctttgaaaaagttagcattggcattgcaggagagaaagtatgctattgaagatctgaaagatcaaaagcagaaaatgatagagcatctgaatttagatgacaaggagttagtcaaagaacagacgagtcatttagagcaacgttggtttcagcttgaggacctcattaaaaggaaaatccaagtgtcagtcaccaacttggaggagttaaatgtggtgcagtccagatttcaggagctaatggagtgggcagaagagcaacaacccaacatcgccgaggcccttaagcagagccctcctccagatatggctcagaaccttctcatggatcacctggccatctgcagtgaactggaggccaagcagatgctcctgaaatcgcttataaaggacgcagacagggtcatggcagatcttggtctcaatgagcgacaggtcatccagaaggctctctctgatgcacaaagccacgtgaattgtctcagtgacttagtgggccagcgaagaaagaagcattttaaggaagattttgataaagcttgccactggctaaaacaagcagatattgttacatttcctgaaatcaacctaatgaatgagagttctgagcttcatacacaactggctaaataccaaaacattcttgaacaatctccagaatatgaaaatcttctacttacgctgcagagaactgggcagaccatattaccatcgctgaatgaagtcgatcattcctacctcagtgaaaagctaaatgctttgcctcgacaatttaatgtaattgttgccttggctaaagacaagttctataaagtccaggaagcaattcttgctcggaaggaatatgcttccttgattgagttgacaacccagtctctgagtgaacttgaagcccaattcttgaggatgagcaaagttcccaccgacctggccgttgaggaggctctttctctgcaagatggttgcagagccattctggacgaggtggcgggccttggggaggcggtggatgaactgaaccagaaaaaagaaggttttcgcagcacaggtcagccttggcagccagacaagatgctgcaccttgtcaccttatatcacaggctgaagcgacaaacagaacagagggttagcttattagaagacaccaccagtgcttaccaagaacacgagaagatgtgccaacagctggagagacaactgaagtctgtaaaagaggagcagtccaaagtgaatgaggaaacgctgcctgcagaggagaagctcaaaatgtatcactccctggcaggaagtctccaggactcagggattgtactgaaacgagtaaccatacatcttgaagatcttgccccacaccttgaccccttggcttatgagaaagccaggcatcagatccagtcctggcaaggggagttaaaactgttgacttctgccattggtgagacggtgacagaatgtgagagccgaatggtgcagagtatagacttccagactgagatgagtcgctccctggactggctgaggagagtgaaggcagagctcagtgggccggtgtacctagacctcaacctgcaggacatccaagaggaaatcagaaaaatccaaattcatcaggaagaggtccagtccagcttgagaatcatgaatgcgctgagtcacaaggaaaaggagaagttcacaaaggccaaggagctgatttctgcggatttagaacacagcctcgctgagctctcagagctggatggagacatccaggaagccttacgcaccagacaggctaccttgactgaaatatatagccagtgtcaaaggtattatcaggtatttcaagcagccaatgactggcttgaggatgcccaagaattgttacagctggcaggcaatggcctagacgtggagagcgcagaggaaaatctcaaaagccacatggaatttttcagtacagaggatcagttccatagtaacctggaggagctccacagcctggtagccaccctggacccactcatcaagccaaccggcaaagaagacctagaacagaaagtggcttctctggaactcaggagccagaggatgagccgggactctggtgcccaagctttagtgtcagtggttaactctttccatgagaaaattgtggcccttgaggaaaaagcttcacaactggagaaaaccggaaatgatgccagcaaagccaccctgagcaggtcaatgaccaccgtctggcagcgctggacacgccttcgagctgtggcccaggaccaggagaagatcctggaagatgcagtggatgagtggacgggctttaacaacaaggttaaaaaggccactgaaatgattgatcagctgcaagataagttacctggaagttcagcagagaaagcatcgaaagcagagctcttaactcttcttgaataccacgacacgttcgttctggagctggagcagcagcagtcggccttgggcatgctgcggcagcaaaccctgagcatgctccaggatggagccgccccaacccctggggaagagcctccgctcatgcaggaaatcaccgccatgcaagatcggtgcctgaaaatggtggagactcagatcaattctgtgaaatgttgggttcaggaaacgaaagaatatttagggaatccaacaatagaaatagatgctcaacttgaagaacttcagattctcctaacagaagccacaaatcaccgacagaacattgaaaaaatggcagaagaacagaaggagaagtacttaggtctttataccatattaccttctgaactctcccttcagttggctgaagtggcgttagatctaaagatccgagatcagatccaagacaaaataaaagaagttgagcagagcaaggccacgagccaggaactcagccggcaaattcagaagttagctaaagacctcacaactattctaactaagctgaaagcgaagacagataatgtagttcaagctaaaactgaccaaaaggcagcatcacatttagaagaatacaatgaaatgcttgaattaattttgaagtggattgaaaaagctaaagtcttggctcatggaactattgcatggaattctgcaagccagcttcgggaacaatatattttgcatcagaccctgctagaagaatccaaagaaattgacagtgagctggaagcaatgactgagaaattacagtacctcactagcgtgtactgtacagaaaaaatgtctcagcaagtggcagaactgggacgggagactgaggagttgcgacagatgatcaaaattcgtttgcagaacctccaagatgcagctaaggatatgaaaaaatttgaagcagagttgaaaaagttacaagctgccttggagcaagcccaggcaacactgacttctccagaagttggacgtctcagtctcaaggagcagctctctcatcggcagcatttgttgtctgagatggagtcactgaagccgaaggtgcaagcagtgcagctctgccagagtgccctccggatccccgaggatgtggttgccagcttacctctctgtcatgctgctctgcggctgcaggaagaggccagccggctgcagcacaccgccatccagcagtgtaacatcatgcaggaagctgtggtacaatatgaacaatatgagcaagaaatgaaacatctccagcaactgatagaaggagctcacagagagattgaggataaacctgttgccaccagtaacatacaggagctgcaggctcagatttctcggcatgaggagctggcgcagaaaattaagggctaccaggagcagatcgcttctttgaattccaagtgcaagatgctgacgatgaaagccaagcacgccaccatgctgctgacggtgaccgaggtcgaggggctggcggaagggacagaggacctggatggggagctcctccccacgccttcggcccacccctctgtggtcatgatgactgcaggtcgctgtcacactttgctgtcaccggtcactgaggagtctggggaggagggaaccaacagtgagatttcctctccacctgcctgtcgctccccttcacctgtggctaatacagatgcttctgttaaccaggacattgcatattaccaagccttgtctgctgagaggttgcagacagatgctgcaaaaattcaccccagcacatccgcatcccaggagttctatgaaccgggattggagccatccgctactgccaaactgggtgatttgcagcgttcttgggaaaccttaaagaatgtgatcagtgagaagcagcgcacactctatgaagctttggaacgccagcagaagtaccaggactccctccagtccatctctacgaagatggaggccattgagctgaaactcagtgagagcccagagcctggcaggagtccagaaagccagatggctgaacatcaggcattgatggatgagattctcatgctccaggatgaaatcaatgagctccagtcctctctcgcagaggagctggtatccgagtcttgtgaggccgaccctgcggagcagctggccttgcagtccacgctcactgtcttagccgagcgaatgtccaccatcaggatgaaagcctcggggaaacggcagcttttggaggagaagttgaatgatcagctggaggaacaaaggcaggaacaggccctgcagaggtatcgctgtgaagccgatgagctggacagctggctcttgagtaccaaggccactctggacactgcgctgagtccacccaaggagcccatggacatggaggcccagcttatggactgccagaatatgctggtggaaatagagcagaaggtggtggctttatcagaactgtcagtccacaatgagaacctgctgctggagggcaaagctcacaccaaggacgaggccgagcagctggctggaaagctgagaaggctcaaggggagcctgctggagctgcagagagccctgcatgataagcagctcaacatgcagggaacagcacaggagaaggaggagagcgatgttgacctaacagccacgcagagccccggcgtccaggaatggctggcccaagctcgcaccacatggacccagcagcggcagagcagtctccagcaacaaaaagagttagaacaggaattagccgagcagaagagtctccttcgctcagtagccagtcgtggagaggagattctaattcaacattcggcggcagagacctctggtgatgctggcgaaaaacctgatgtgttatcccaggagttggggatggaaggggagaaatcatccgctgaagaccagatgagaatgaaatgggaaagcctacatcaagaatttagtaccaagcagaaactactacagaatgttctggaacaggaacaagagcaagtgctttatagcaggccaaatcgactcttgtctggtgtgccactgtacaaaggggacgtgccaacccaagataaatctgcagttacatctttgctggatggactgaaccaagccttcgaggaggtttcatcccagagtggaggggcaaagaggcagagtatacacttggagcagaagttgtatgatggagtctcagccacctctacttggttggatgacgttgaagaacgtttatttgttgccacagcacttttaccagaagaaacagagacttgtctcttcaaccaagagattcttgccaaagacattaaggaaatgtctgaagaaatggataagaacaaaaacttgttttcccaagcttttccagagaatggtgataatcgagatgttattgaagatactttgggttgtcttttgggcaggttatccttgctagactcagtagtgaatcaacgatgtcatcagatgaaagaaagacttcagcaaatactaaatttccagaatgatctgaaagtgctgtttacatcactggctgacaacaaatacatcattctgcaaaaactggcaaatgtgtttgaacagcccgtagcagaacaaatagaggcaatacaacaggctgaagatggactcaaagaatttgatgcaggaatcattgaattaaagaggcgtggtgacaagctacaggtcgagcagccgtccatgcaagaactctccaagctccaggacatgtatgatgagctgatgatgatcattggctcccggaggagtggtctgaatcagaaccttacactcaagagtcagtatgagagggccctacaagatctggctgacctgctagaaactggtcaggagaagatggcaggagaccagaaaatcatcgtgtcttccaaagaggaaatccagcaactacttgacaaacataaggaatactttcagggcctggaatctcatatgatcttgactgaaacactcttcagaaagataatcagctttgcagtccaaaaggaaacccagttccatacagagctgatggctcaggcttctgctgtactgaaacgggctcacaagaggggtgtggagctggagtacattctagagacgtggtcccatctggatgaggaccagcaggagctcagcagacagctggaggtggtggaaagcagcatcccaagcgtgggtctggtggaggagaacgaggacaggcttattgaccgcataacactctaccagcatttaaaatctagccttaatgaataccagcccaaattatatcaagtattagatgatgggaaacgacttctgatatccatcagctgctcagatctagaaagccaactaaatcaacttggagagtgctggctaagtaacaccaataaaatgtctaaggaacttcacagactggaaacaatattgaaacactggaccagatatcaaagtgaatctgcagatctaattcactggttacaatctgcaaaagaccggctagaattttggactcagcaatctgtgacagtcccacaagagctggaaatggtccgtgatcatctaaatgctttcctggagttttctaaagaagtggatgcccaatcttccctgaaatcatctgttctgagtactggaaatcagctccttcgactaaaaaaggtggacacagccacgctgcgctctgagctgtcgcgcattgatagccagtggactgacctgctaaccaatatcccagccgtccaggagaagctccaccagctccagatggataaactgccttcccgccatgccatttctgaagtcatgagttggatttctctaatggaaaatgttattcagaaggatgaagataatattaaaaattccataggttacaaggcaattcatgaataccttcagaaatataagggttttaagatagacattaactgtaaacagctgacagtggattttgtgaaccagtccgtgctacaaatcagcagtcaggatgtggaaagtaagcgtagtgataagactgattttgctgagcaacttggagcaatgaataaaagttggcaaattctgcaaggtctagtaactgagaagatccagctgttggaaggcttattggaatcttggtcagaatatgaaaataatgtacaatgtctgaaaacatggtttgaaacccaggaaaagagactaaaacaacagcatcgaattggagatcaggcttctgttcaaaatgcactgaaagactgtcaggatctggaagatttgattaaagcaaaagaaaaagaagtagagaaaattgagcagaatggacttgctttgattcagaacaagaaagaagacgtctctagcattgtcatgagcacactgcgagagctcggccaaacctgggcaaatttagatcacatggttggacaattaaagatactgctgaaatcagtgcttgaccaatggagtagtcacaaagtggcctttgacaagataaacagttacctcatggaggccagatactctctttcccgattccgtctgctgactggctccttagaagctgtgcaagttcaggtggacaatcttcagaatctccaagatgatctggaaaaacaggaaaggagcttacagaaatttggctctatcaccaaccaattattaaaagagtgtcacccacccgtgacagaaactcttaccaatacactgaaagaagtcaacatgagatggaataacttgctggaagagattgctgagcagctacagtccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgacctcctcaaaggactgggcacagttaaagattccctcttttttctccatgagctgggagagcaactgaagcaacaagtggatgcttccgcagcatcagctattcaatcggatcaactctctttgagtcaacacttgtgtgccctggagcaagctctctgcaaacagcagacttcattacaggctggagttcttgattatgaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaaatgagcttggatataggttacccttgaatgataaggaaatcaaaagaatgcagaatctgaaccgccattggtctctgatctcctctcagactacagaaagattcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgagttgtttcaagccgagatgttcagtcgtcagcagattttgcactcaatcattattgatgggcaacgtcttctagaacaaggtcaagttgatgacagggatgaattcaacctgaaattgacactcctcagtaatcaatggcagggagtgattcgcagggcccagcagaggcgggggatcattgacagccagattcgccagtggcagcgctatagggagatggcagaaaagcttcgtaaatggttggttgaagtgtcctacctccccatgagtggtctcggaagtgttcctataccactgcaacaagcaaggaccctctttgatgaagtgcagttcaaagaaaaagtgtttctgcggcaacaaggcagctacatcctgactgtggaggctggcaagcaactccttctctcggcggacagtggcgctgaggccgccttgcaggccgaactcgctgaaatccaagagaaatggaaatcagccagcatgcggctggaagaacagaagaaaaaactagccttcttgttgaaagactgggaaaaatgtgagaaaggaatagcagattccctggagaaactacgaactttcaaaaagaagctttcgcagtctctcccggatcaccatgaagagctccatgcagaacaaatgcgttgcaaggaattagaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagcagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttggcttatcaggggaccacagtgccctagagtcacagatccgacaactgggcaaagccctggatgatagccgttttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacgccacgaggcaagtgtagtctctcacagcctggaccctctgtcagcagtccacatagcaggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaaagatatttatgtatgtacagtttgctaaagccaagttttgtttgtattgatttctttgcatttattatagatattataaaata

SEQ ID NO: 29624 - DNA, 10835 bp, Homo sapiens
caaaaatcagtctgatctcgggaaacctggagaaatttattttctgtactctaatgttctttcattttggtgaccatcaaggtgctgggagaggaattagatggctgtaattcaaagttaatggaattagatgcagcagtacagaaattcttggaacagaatggccaactgggtaagccactggccaagaagataggaaaactgactgaacttcaccagcagaccattagacaagctgagaatcggctctccaagctcaatcaggcagcatcacatttagaagaatacaatgaaatgcttgaattaattttgaagtggattgaaaaagctaaagtcttggctcatggaactattgcatggaattctgcaagccagcttcgggaacaatatattttgcatcagaccctgctagaagaatccaaagaaattgacagtgagctggaagcaatgactgagaaattacagtacctcactagcgtgtactgtacagaaaaaatgtctcagcaagtggcagaactgggacgggagactgaggagttgcgacagatgatcaaaattcgtttgcagaacctccaagatgcagctaaggatatgaaaaaatttgaagcagagttgaaaaagttacaagctgccttggagcaagcccaggcaacactgacttctccagaagttggacgtctcagtctcaaggagcagctctctcatcggcagcatttgttgtctgagatggagtcactgaagccgaaggtgcaagcagtgcagctctgccagagtgccctccggatccccgaggatgtggttgccagcttacctctctgtcatgctgctctgcggctgcaggaagaggccagccggctgcagcacaccgccatccagcagtgtaacatcatgcaggcagctgtggtacaatatgaacaatatgagcaagaaatgaaacatctccagcaactgatagaaggagctcacagagagattgaggataaacctgttgccaccagtaacatacaggagctgcaggctcagatttctcggcatgaggagctggcgcagaaaattaagggctaccaggagcagatcgcttctttgaattccaagtgcaagatgctgacgatgaaagccaagcacgccaccatgctgctgacggtgaccgaggtcgaggggctggcggaagggacagaggacctggatggggagctcctccccacgccttcggcccacccctctgtggtcatgatgactgcaggtcgctgtcacactttgctgtcaccggtcactgaggagtctggggaggagggaaccaacagtgagatttcctctccacctgcctgtcgctccccttcacctgtggctaatacagatgcttctgttaaccaggacattgcatattaccaagccttgtctgctgagaggttgcagacagatgctgcaaaaattcaccccagcacatccgcatcccaggagttctatgaaccgggattggagccatccgctactgccaaactgggtgatttgcagcgttcttgggaaaccttaaagaatgtgatcagtgagaagcagcgcacactctatgaagctttggaacgccagcagaagtaccaggactccctccagtccatctctacgaagatggaggccattgagctgaaactcagtgagagcccagagcctggcaggagtccagaaagccagatggctgaacatcaggcattgatggatgagattctcatgctccaggatgaaatcaatgagctccagtcctctctcgcagaggagctggtatccgagtcttgtgaggccgaccctgcggagcagctggccttgcagtccacgctcactgtcttagccgagcgaatgtccaccatcaggatgaaagcctcggggaaacggcagcttttggaggagaagttgaatgatcagctggaggaacaaaggcaggaacaggccctgcagaggtatcgctgtgaagccgatgagctggacagctggctcttgagtaccaaggccactctggacactgcgctgagtccacccaaggagcccatggacatggaggcccagcttatggactgccagaatatgctggtggaaatagagcagaaggtggtggctttatcagaactgtcagtccacaatgagaacctgctgctggagggcaaagctcacaccaaggacgaggccgagcagctggctggaaagctgagaaggctcaaggggagcctgctggagctgcagagagccctgcatgataagcagctcaacatgcagggaacagcacaggagaaggaggagagcgatgttgacctaacagccacgcagagccccggcgtccaggaatggctggcccaagctcgcaccacatggacccagcagcggcagagcagtctccagcaacaaaaagagttagaacaggaattagccgagcagaagagtctccttcgctcagtagccagtcgtggagaggagattctaattcaacattcggcggcagagacctctggtgatgctggcgaaaaacctgatgtgttatcccaggagttggggatggaaggggagaaatcatccgctgaagaccagatgagaatgaaatgggaaagcctacatcaagaatttagtaccaagcagaaactactacagaatgttctggaacaggaacaagagcaagtgctttatagcaggccaaatcgactcttgtctggtgtgccactgtacaaaggggacgtgccaacccaagataaatctgcagttacatctttgctggatggactgaaccaagccttcgaggaggtttcatcccagagtggaggggcaaagaggcagagtatacacttggagcagaagttgtatgatggagtctcagccacctctacttggttggatgacgttgaagaacgtttatttgttgccacagcacttttaccagaagaaacagagacttgtctcttcaaccaagagattcttgccaaagacattaaggaaatgtctgaagaaatggataagaacaaaaacttgttttcccaagcttttccagagaatggtgataatcgagatgttattgaagatactttgggttgtcttttgggcaggttatccttgctagactcagtagtgaatcaacgatgtcatcagatgaaagaaagacttcagcaaatactaaatttccagaatgatctgaaagtgctgtttacatcactggctgacaacaaatacatcattctgcaaaaactggcaaatgtgtttgaacagcccgtagcagaacaaatagaggcaatacaacaggctgaagatggactcaaagaatttgatgcaggaatcattgaattaaagaggcgtggtgacaagctacaggtcgagcagccgtccatgcaagaactctccaagctccaggacatgtatgatgagctgatgatgatcattggctcccggaggagtggtctgaatcagaaccttacactcaagagtcagtatgagagggccctacaagatctggctgacctgctagaaactggtcaggagaagatggcaggagaccagaaaatcatcgtgtcttccaaagaggaaatccagcaactacttgacaaacataaggaatactttcagggcctggaatctcatatgatcttgactgaaacactcttcagaaagataatcagctttgcagtccaaaaggaaacccagttccatacagagctgatggctcaggcttctgctgtactgaaacgggctcacaagaggggtgtggagctggagtacattctagagacgtggtcccatctggatgaggaccagcaggagctcagcagacagctggaggtggtggaaagcagcatcccaagcgtgggtctggtggaggagaacgaggacaggcttattgaccgcataacactctaccagcatttaaaatctagccttaatgaataccagcccaaattatatcaagtattagatgatgggaaacgacttctgatatccatcagctgctcagatctagaaagccaactaaatcaacttggagagtgctggctaagtaacaccaataaaatgtctaaggaacttcacagactggaaacaatattgaaacactggaccagatatcaaagtgaatctgcagatctaattcactggttacaatctgcaaaagaccggctagaattttggactcagcaatctgtgacagtcccacaagagctggaaatggtccgtgatcatctaaatgctttcctggagttttctaaagaagtggatgcccaatcttccctgaaatcatctgttctgagtactggaaatcagctccttcgactaaaaaaggtggacacagccacgctgcgctctgagctgtcgcgcattgatagccagtggactgacctgctaaccaatatcccagccgtccaggagaagctccaccagctccagatggataaactgccttcccgccatgccatttctgaagtcatgagttggatttctctaatggaaaatgttattcagaaggatgaagataatattaaaaattccataggttacaaggcaattcatgaataccttcagaaatataagggttttaagatagacattaactgtaaacagctgacagtggattttgtgaaccagtccgtgctacaaatcagcagtcaggatgtggaaagtaagcgtagtgataagactgattttgctgagcaacttggagcaatgaataaaagttggcaaattctgcaaggtctagtaactgagaagatccagctgttggaaggcttattggaatcttggtcagaatatgaaaataatgtacaatgtctgaaaacatggtttgaaacccaggaaaagagactaaaacaacagcatcgaattggagatcaggcttctgttcaaaatgcactgaaagactgtcaggatctggaagatttgattaaagcaaaagaaaaagaagtagagaaaattgagcagaatggacttgctttgattcagaacaagaaagaagacgtctctagcattgtcatgagcacactgcgagagctcggccaaacctgggcaaatttagatcacatggttggacaattaaagatactgctgaaatcagtgcttgaccaatggagtagtcacaaagtggcctttgacaagataaacagttacctcatggaggccagatactctctttcccgattccgtctgctgactggctccttagaagctgtgcaagttcaggtggacaatcttcagaatctccaagatgatctggaaaaacaggaaaggagcttacagaaatttggctctatcaccaaccaattattaaaagagtgtcacccacccgtgacagaaactcttaccaatacactgaaagaagtcaacatgagatggaataacttgctggaagagattgctgagcagctacagtccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgacctcctcaaaggactgggcacagttaaagattccctcttttttctccatgagctgggagagcaactgaagcaacaagtggatgcttccgcagcatcagctattcaatcggatcaactctctttgagtcaacacttgtgtgccctggagcaagctctctgcaaacagcagacttcattacaggctggagttcttgattatgaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaaatgagcttggatataggttacccttgaatgataaggaaatcaaaagaatgcagaatctgaaccgccattggtctctgatctcctctcagactacagaaagattcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgagttgtttcaagccgagatgttcagtcgtcagcagattttgcactcaatcattattgatgggcaacgtcttctagaacaaggtcaagttgatgacagggatgaattcaacctgaaattgacactcctcagtaatcaatggcagggagtgattcgcagggcccagcagaggcgggggatcattgacagccagattcgccagtggcagcgctatagggagatggcagaaaagcttcgtaaatggttggttgaagtgtcctacctccccatgagtggtctcggaagtgttcctataccactgcaacaagcaaggaccctctttgatgaagtgcagttcaaagaaaaagtgtttctgcggcaacaaggcagctacatcctgactgtggaggctggcaagcaactccttctctcggcggacagtggcgctgaggccgccttgcaggccgaactcgctgaaatccaagagaaatggaaatcagccagcatgcggctggaagaacagaagaaaaaactagccttcttgttgaaagactgggaaaaatgtgagaaaggaatagcagattccctggagaaactacgaactttcaaaaagaagctttcgcagtctctcccggatcaccatgaagagctccatgcagaacaaatgcgttgcaaggaattagaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagcagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttggcttatcaggggaccacagtgccctagagtcacagatccgacaactgggcaaagccctggatgatagccgttttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacgccacgaggcaagtgtagtctctcacagcctggaccctctgtcagcagtccacatagcaggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaaagatatttatgtatgtacagtttgctaaagccaagttttgtttgtattgatttctttgcatttattatagatattataaaata

SEQ ID NO: 29625 - DNA, 3683 bp, Homo sapiens
atggtggtggcggaggacctgagtgccctgaggatggcagaggacagctgtgtggatgcagatctcccagattgtaactgcgatgtcacaaggcagagggtgaagaagctgaaggagaccctggtagccgtgcagcagcttgataagaacatgagcagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttggcttatcagatgtaatgatccccgaaagccctgaggcctatgtaaaactcacagaaaatgcaatcaaaaatacctccggggaccacagtgccctagagtcacagatccgacaactgggcaaagccctggatgatagccgttttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacgccacgaggcaagtgtagtctctcacagcctggaccctctgtcagcagtccacatagcaggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaaagatatttatgtatgtacagtttgctaaagccaagttttgtttgtattgatttctttgcatttattatagatattataaaata

SEQ ID NO: 29626 - DNA, 27748 bp, Homo sapiens
cccgggcagtggaaaccgtgggcaaaagttagctggcaggacagcgcagctcctccaggcagcggaggcagcgcgtcccggctctcagggacatttccttcccacctcgacccccgggaggtggtcccggtataaaggctcgctgagcgggtgggtcacagcacagctttgcagctgcggagaaacgcccaaggccgtgcatctccaggagggcggctgggctcccgcagtcctgcagaccgcgcccgatcccggcgacagggcgggcggacagccgcgcatccccggggtcccgccgagcctgggcgcagagagccgggaggaagcgttcgctcgcttcgccttgctgctgggaaactgaacgaggccgagagagaaggttcttgagttcatgtaagaggacagtcttaaaacggaagaagaaaaagaagcagttcagtctttgggagagctgcctccttgttgagtgctgcaaaggcctggaattcatttatgacagaatagatctagaaaagtccaagcatgttttctagagtggtgtagccctgtgctgcctccagtgaagagtctcttggtgttggcttcgtgcttccggagggaccatggcaacctccagaggggcctcccggtgtcctcgggatatcgccaatgtgatgcagaggctgcaagatgagcaagagatagtacaaaaacgaactttcacaaaatggatcaactctcatctggccaagcggaaacctccaatggtggtggacgatctttttgaagacatgaaagatggtgttaaactgcttgcccttctggaggtcctgtctgggcagaaactgccttgtgaacaaggacgccggatgaagcgaatccatgctgtggctaacattggcacggcactcaagttcctcgaaggaagaaagattaaattagtcaacattaactccaccgatatagctgatggccgaccctcaatagttcttggattgatgtggaccattattctatatttccagattgaagagttgaccagcaacctgccccagctccagtctttgtccagcagcgcatcctccgtggacagcatagttagctctgagactcccagcccaccaagtaaacggaaggtgaccaccaagatccaaggaaatgctaagaaggctttattaaagtgggttcagtacacagctggcaagcagactggaatagaagtaaaagattttgggaagagttggagaagcggggttgcctttcattcagttattcatgccattcgaccggaattggtggacttggagacagtgaaaggcagatccaaccgagaaaatttggaggatgctttcactatcgccgaaacagaactggggatcccaagactgctagatcctgaagacgttgatgtggataaaccagatgagaaatctattatgacctatgtagcccagtttctgaaacattatcctgacatccacaatgcaagcactgatgggcaagaggatgatgaaatacttccaggtttcccatcttttgcaaattctgtacaaaattttaagagagaagacagagtaatttttaaggaaatgaaagtttggatagaacaatttgagagagatttgacaagagcacagatggtggaatcaaatttacaggataaatatcagtcatttaagcacttcagagttcaatatgaaatgaagaggaaacagattgaacatttaatacaaccattacacagagacggtaaattgtcacttgaccaagcattggtaaaacaatcttgggatagagtgacctccaggctctttgactggcatatacagcttgataaatctcttcctgcacctctgggcaccataggtgcctggctgtacagagcggaggtggccctgagagaggaaataaccgttcaacaggtccacgaggaaacagcaaacacgatacaacggaaacttgagcaacataaggatctgcttcaaaacacggatgcccacaaaagagcattccatgaaatctaccggaccaggtctgttaacgggattccagtgccacctgatcaattagaggacatggccgagaggtttcattttgtttcctccacatcagagctacacctaatgaaaatggaatttttagaattaaagtaccgtctgctctcactgctggttcttgcagagtcaaagctgaagtcttggatcattaagtacgggaggagagagtcagtggagcagcttctacaaaactacgtgtcttttatagaaaatagcaagttctttgaacaatatgaggtgacataccagatcttgaaacagacagctgagatgtatgtcaaagcagatggttcagtggaagaagctgagaatgtgatgaaattcatgaatgaaaccaccgctcagtggaggaatctctcagtagaagtgaggagtgtgaggagcatgctggaagaagtgatctctaactgggatcgctatggcaatacagtggctagtctgcaagcctggctagaggatgctgaaaaaatgctcaatcaatcagaaaatgccaaaaaggatttttttcgaaatttacctcattggattcagcagcatactgccatgaacgatgctggcaattttctaattgaaacctgtgatgagatggtttcccgtgacctgaagcagcaattactgttgctaaatgggcggtggagggagttgtttatggaagtcaagcaatatgctcaagctgatgagatggacagaatgaagaaggaatacacagactgtgttgttaccctgtctgcttttgcaacggaagcccataagaaactttctgaacccttagaagtctcttttatgaatgtcaagctattaattcaagacttggaggatattgagcagagggtgcctgtgatggatgcccaatacaagataattacaaagacagcacacctcattaccaaagaaagcccccaagaagaaggaaaagaaatgtttgcgaccatgtcaaagctcaaagagcagctaaccaaggtcaaagaatgttactccccactcctttatgagtctcagcagctgttgattccgttggaggaattagaaaagcagatgacgtccttttatgactcacttgggaaaatcaatgaaattatcacagttcttgagcgtgaggcacaatcgagtgccctttttaaacaaaaacatcaggaactgttagcttgtcaagaaaactgtaagaaaaccttgacacttattgagaaaggcagtcaaagtgttcaaaagtttgtgaccttgagcaacgtgttaaagcattttgatcagacgaggctacaaagacagattgcagatattcatgttgcttttcagagtatggtaaagaaaactggagattggaagaagcatgtggaaaccaacagtcgcttgatgaagaagtttgaggagtctcgagcagagttggagaaggtactgcggattgctcaggagggcctggaggaaaagggggatccagaggagctcctgcggagacacactgagtttttcagtcagctggatcagagggtgctcaatgctttcctgaaagcttgtgatgaactcaccgacatccttccagagcaggagcagcaggggctgcaggaagctgttcgaaagctccacaaacaatggaaggatcttcaaggagaagccccttatcatttgcttcatctgaagattgatgtggagaagaataggttcttagcctctgtagaagaatgcagaactgagctggatcgagagaccaagctgatgccccaggaaggcagtgaaaagataattaaagagcacagggttttcttcagtgacaaaggtcctcatcatctctgtgagaaaaggttacagctcatcgaggaactctgtgtgaaactcccagtgcgggacccagtaagggacacacctggaacctgtcacgtgactctcaaagagctcagagctgccattgacagcacctacaggaagctcatggaagacccagacaagtggaaggactacactagcagattctctgagttctcatcttggatatctacaaatgagacacaattaaaggggatcaagggtgaggccatcgatactgccaaccacggagaggttaaacgtgccgttgaagagatcagaaatggtgttaccaaaaggggtgagaccctcagctggctgaaatccaggctgaaagttttgacagaagtttcttctgagaatgaagcccaaaagcagggagatgagctggcaaaattatccagctctttcaaggctcttgtgacgctgctgtcagaggttgaaaagatgctaagcaattttggggactgtgtccagtacaaagaaatagtcaaaaattctctcgaagaattaatttctggctctaaagaagtccaggaacaagctgagaagatcttggatactgaaaatctgtttgaagcacagcagttacttcttcatcaccagcaaaagacaaagcggatctcagcaaagaagagagatgtgcagcagcagatcgcgcaggcgcagcagggagaaggggggctgcctgaccgaggccacgaggagctgcggaagctggagagcacactggatggcctggagcgcagccgggagaggcaggaacgccgcatccaggtcacattaagaaaatgggagcgatttgaaacaaacaaagaaacagtagtaagatacctttttcaaacaggttccagtcatgaacgcttcttgagttttagcagtttggaaagtttatcttcagaactggaacaaacaaaggagttttctaaacggacagaaagtattgcagtccaggctgagaaccttgtaaaggaagcttcagagataccgcttgggccccaaaataagcagctgcttcaacagcaggccaagtcaatcaaagaacaagtcaaaaaattagaagacacgcttgaagaagatattaaaaccatggaaatggtgaaaaccaagtgggatcattttggcagtaattttgagactctgtccgtctggataactgagaaagaaaaagaactcaatgccttggaaacttcgtcatctgccatggacatgcaaatcagccaaattaaggtcacaattcaggaaatagaaagtaagctcagcagcattgtaggattagaagaagaagcccagtcttttgctcagtttgttaccactggagaatctgctcgaattaaagccaagttgacacaaataagaagatacggggaagagcttcgagagcatgcacagtgtctggaaggaacaatcctgggacatttatctcagcagcaaaagtttgaagagaaccttagaaagatccagcaatctgtgtctgaatttgaagataaacttgctgttccaattaaaatatgttcttcagctacagaaacatacaaagttcttcaagaacatatggatctctgccaggccctggagtcactgagcagcgcgatcactgccttctcagccagtgccaggaaggttgtgaacagagattcctgtgttcaggaggctgcggctctacagcagcaatacgaggacatcctaaggagggcgaaggagagacagacggcgctggagaatctgctggcccactggcagaggctagagaaagaactatcatcctttttgacctggttagagcggggtgaagctaaagccagttccccagaaatggacatttctgcagacagagtcaaagtggaaggtgaacttcagttaatacaggcactgcaaaatgaagttgtatcccaggcctcattctatagcaaacttttgcaattgaaggaatcattgttctcagtagcctccaaagatgatgtgaaaatgatgaaactacatttggagcagttggatgagagatggagagatttaccacagatcattaacaaaaggattaattttcttcagtctgtggttgctgaacaccagcaatttgatgagctgctgctttccttttctgtctggattaaactgtttctcagtgaattacaaactacctctgagattagcataatggaccatcaagtagcccttactcggcataaggaccacgcagcagaagtagagagcaaaaagggcgaattgcagagtctgcagggtcacttagcaaagttgggttctctgggccgtgctgaggacctccacctcctgcagggaaaggctgaggactgcttccagctgtttgaggaggccagccaggttgtggagaggcggcagcttgccctgtcccatttggcagaattcctccagagccatgcctctctgtccggcattctccgccagctgaggcaaacagtggaagcaaccaacagtatgaataagaacgagtctgatttgatagaaaaggacctcaatgatgctcttcaaaatgctaaagcattagaatctgctgccgtcagtctggatggcattctttccaaagcccaataccatctgaaaatcgggagctctgagcaaaggacttcctgcagagccacggctgatcagctctgtggagaggtagagaggatccagaaccttctgggaaccaagcagagtgaggcagatgctctggcagtgttgaaaaaagcattccaagaccagaaagaggagcttctgaaaagcattgaggacattgaagaaaggactgacaaagagcgattgaaagaacctacccgccaagctcttcagcagaggttaagagtgtttaatcagctagaagatgaattgaattctcacgagcatgaactatgttggttgaaagacaaagccaagcaaattgcccagaaagatgtagcttttgcacctgaagttgacagggagataaaccgcttagaggtcacctgggatgataccaaaagactaattcatgaaaatcagggtcagtgctgtggacttattgacttaatgagagaatatcagaacctgaaatcagctgtatctaaagtcttagaaaatgccagcagtgtgattgtaaccagaactaccataaaagatcaggaggatcttaaatgggctttttccaagcatgaaactgccaagaacaaaatgaattacaaacagaaagacttggataactttaccagcaaaggaaaacacttgttatctgagctgaagaaaattcacagtagtgatttcagcttggtgaaaacagacatggagagcaccgtggacaaatggctggatgtatcagagaaacttgaagaaaacatggataggctgagagtaagcctgtccatttgggatgatgtactgtcaactagagatgagattgagggatggtcaaacaactgcgttccacagatggcagaaaacatcagcaacctggataaccacctcagagctgaagaactgcttaaagaatttgagtctgaagttaaaaacaaagcattgagattggaagaactgcattccaaagttaatgatctgaaagaattaactaaaaatctagaaacaccgccagaccttcagtttatagaagcagacttaatgcagaaactggagcatgccaaagaaataactgaagtagcaaaaggaaccctgaaggatttcacggctcaaagtacacaagtggagaagtttattaatgacataacaacatggttcacaaaagtggaagaatcgttgatgaactgtgcccaaaatgagacttgtgaagcattgaaaaaagtcaaggatatacaaaaagaacttcaaagtcaacaaagcaacatcagctctacccaagaaaatctcaatagcttgtgccgcaagtaccactcagctgagttggagagcctgggccgtgcaatgactggtctgataaagaaacatgaagccgtgagccagttgtgctccaaaacccaggccagcctgcaggaatctctggaaaaacacttcagtgagtctatgcaggaattccaagaatggtttttgggagcaaaggcagcagcaaaagaatcatcagatcgcaccggtgacagcaaagttctagaagcaaagctccatgatcttcagaacattttggactcagtcagtgatgggcagagcaaacttgatgcagtgactcaagaaggacaaactttgtatgcacatttgtctaaacaaattgtcagtagcattcaagaacaaatcacaaaggccaatgaagagtttcaagcatttctgaaacaatgccttaaagataagcaggctcttcaagactgtgcttcagaacttggaagctttgaagatcagcacagaaaactgaacttatggatccatgaaatggaagaaaggttcaatacggaaaacttgggagagagtaaacagcacattcctgagaagaaaaatgaagttcataaagttgaaatgtttttgggagaactgctggctgcaagagagtctcttgataagctttcccagagagggcagcttctgagtgaagaaggccacggtgctgggcaggagggccgcctgtgttcccagctcctcacaagccaccagaacctacttagaatgaccaaagagaaactccggagctgccaggtggcccttcaggagcacgaagccctggaggaagcactgcaaagcatgtggttctgggtgaaggccattcaggacagactggcctgtgcagagagcactcttgggagcaaagacaccctggagaaacggctgtcacaaatacaggatattctcctgatgaaaggtgaaggggaagttaagttgaatatggccattggcaagggggaacaggccttgagaagtagcaacaaagaaggtcagagggtgattcagactcagttagagacccttaaagaagtgtgggctgacatcatgagctcctccgtccacgctcaaagcactttagagtctgtgattagccaatggaatgactatgtagagaggaaaaaccagttggagcagtggatggaatcagtggatcaaaaaatagaacatcccttacaaccacagccaggtctgaaagagaagttcgtcctgcttgaccacctccagtccatcctgtctgaggcagaagatcacacgagagcccttcaccgtctaattgcgaagtccagggagctctacgaaaagacagaggatgagtctttcaaggacacagctcaagaggagctgaaaacacagtttaatgatataatgactgttgccaaggaaaaaatgaggaaagtggaagagattgtgaaagatcatctaatgtatttagatgcggtccacgagttcacagattggctccattcagcaaaggaagaacttcaccggtggtcagatatgtctggagattcatcagccacccagaaaaagttatcaaaaattaaggagctgatagattccagagagattggtgcaagccgtctcagcagagtggagtcgctggctcccgaagtgaaacagaacacaactgccagtgggtgtgagctcatgcacacggagatgcaggccctgcgtgccgactggaagcagtgggaagacagtgtattccaaacgcagagctgtttggagaacctggtcagccagatggccctttcggagcaggaattctcaggccaagtggctcaactggagcaggccctggaacagttcagtgcccttctgaaaacctgggctcagcagttaaccctcctggaaggcaagaacacggatgaggagatagtggaatgctggcacaaaggacaagagatactggatgctttgcaaaaagcagagcctagaacagaggatctcaagtctcagctgaatgaactttgtcgattttccagagacctgagtacctacagtggaaaagtttctggcttgattaaagagtataattgtctttgtttgcaagcatccaagggctgccagaataaagaacagattttacagcaaagatttcgaaaggccttcagggatttccagcagtggttggttaatgcaaaaatcactaccgccaagtgttttgatatacctcaaaatataagtgaagtttcaactagtcttcagaaaatacaggagtttttgtcagaaagtgaaaatggacagcacaagctaaacatgatgctgtctaaaggggaacttctgagtaccctgctgaccaaagagaaagcgaaagggatccaggccaaagttacagctgcaaaagaagattggaaaaattttcattcaaatctccaccaaaaagaatctgctctagagaatctaaagatccaaatgaaggactttgaagtaagtgctgagcctatccaggactggctgagtaaaactgagaagatggtccatgaaagcagcaatcgcctctatgatctgccagcaaagaggagggagcagcagaagctccagtctgtccttgaggaaatacactgctacgagcctcagctcaacaggctgaaagagaaagctcagcagctgtgggaaggacaagctgccagcaagagctttaggcacagagtgtcgcagctgtcttctcagtatctagcgctaagcaatttaacaaaggagaaagtgtcaagactggatagaatcgttgcagaacacaatcagttctctcttgggattaaagaattacaagactggatgacggatgcgattcacatgctggattcatactgccacccgacatccgacaaaagtgtgctggacagcaggacgctcaagctcgaggctctattatcagtcaaacaggaaaaagagattcagatgaaaatgatagtgaccaggggagaatctgtccttcagaatacttctccagaaggcattcccactattcagcagcagctgcagagtgtgaaggatatgtgggcatcccttttgtctgcagggattcgttgtaaaagccaactcgaaggagctctctccaagtggacaagttatcaggatggcgttcgacagttctccggttggatggatagtatggaagccaacctgaatgaatcagaaaggcagcatgcggagctgcgggataaaacaacgatgctcggaaaagccaagttattaaatgaagaagtgctgagttacagcagcttgctggagaccatcgaagtcaaaggggctggcatgacagaacactatgtcacccagctagaactccaggatctacaggaacgatacagagccatccaagagagggccaaggaagccgtaaccaagtctgaaaaacttgtccgcctgcaccaagagtatcagagagacctaaaggcatttgaagtttggttggggcaagaacaagaaaagctcgaccagtattcagttcttgaaggtgatgcccacactcatgagacaacattgcgtgatcttcaggagctacaggtacactgtgcagaggggcaggccctgttgaactcagtgctgcacaccagagaggatgtgatcccatcaggtatcccacaggcagaggaccgggctttagagtctctccggcaagactggcaggcttaccagcacaggctgtccgagactcgaactcagttcaataacgtggtgaacaaattgaggctaatggagcaaaagtttcagcaagtagatgaatggctcaaaacagcagaggagaaagttagtcccaggaccagacgtcagtctaacagggcaaccaaggagatacaattacatcagatgaagaagtggcacgaagaagtgactgcatacagagatgaagttgaggaagtgggagctagagctcaggagatactggacgagagccacgtgaacagcagaatgggttgccaggccacccagctgacttccagataccaggccctgcttctccaagtgctggaacaaataaaattcctggaggaggagattcagagtttggaggaatcagaatcatccctcagttcctattctgattggtatggctctactcataaaaacttcaagaatgtggctaccaagattgacaaagtagatacagtaatgatggggaagaaattgaagacgttggaggttttgctcaaagacatggagaaaggtcacagtttgctgaaatcagcccgggagaaaggagagagggctgttaaatacttggaggaaggcgaggcagagaggttaagaaaggagattcatgatcacatggagcagttgaaggaactgaccagcactgtccggaaagaacacatgacgctggaaaaaggtcttcatttagcaaaggaattctcagataaatgcaaagcactgacacagtggatagcagaataccaggaaattctacatgttcctgaagaacccaaaatggaattatatgagaaaaaagctcagttatctaaatacaagtcacttcaacaaacggtgctgtcccatgaaccatcagtaaagtcagtgagagagaagggtgaagctcttttggaactggtgcaggacgtcactttaaaggacaaaatagatcaacttcaaagtgattaccaggacctgtgcagcataggaaaggagcatgtcttcagtctggaggcgaaagtcaaagaccatgaagactacaacagtgagctccaagaggtcgaaaagtggctgctgcagatgtctggcagactggtggcacctgacctcctggagacaagcagcctggagacaatcacccagcaattggcccaccacaaggcaatgatggaagaaattgctggttttgaagaccgtttgaacaatcttcaaatgaaaggtgatactttgattggccaatgtgcagaccacctgcaagcgaaacttaaacaaaacgtgcatgctcatctgcagggcacaaaggacagctactcagcgatctgcagcacagctcagaggatgtaccagagtttggaacacgaacttcagaagcacgtcagccgacaagacaccctgcagcagtgccaggcctggctttctgcagtccagccggatttagagccaagtcctcaaccacctcttagtagggcagaagccattaagcaggtcaaacacttcagagctttgcaagagcaggcaaggacctacctagatctcctttgctccatgtgtgacctgtcaaatgcttcggtgaaaaccacagcaaaagacattcaacaaacagagcaaacgattgaacaaaagcttgtccaggcccagaacttaactcagggctgggaagagatcaagcacctgaagtctgagctctggatttacctgcaagatgctgatcagcaactgcagaacatgaagaggaggcactctgagctggagctgaacattgcacagaacatggtttcacaagttaaggattttgttaagaaactacagagcaaacaggcatccgtgaacaccataatagaaaaggtgaataagttaacaaagaaggaggaatcgcctgaacacaaggaaataaatcatttaaatgatcagtggctcgatttgtgccgtcagtctaacaacctgtgcttgcaaagggaagaggatcttcagagaacaagagattaccatgactgtatgaatgttgttgaagtgttcctagaaaaatttactacagaatgggataacttggccagatctgatgcagagagtacagctgtccacctggaagctttgaaaaagttagcattggcattgcaggagagaaagtatgctattgaagatctgaaagatcaaaagcagaaaatgatagagcatctgaatttagatgacaaggagttagtcaaagaacagacgagtcatttagagcaacgttggtttcagcttgaggacctcattaaaaggaaaatccaagtgtcagtcaccaacttggaggagttaaatgtggtgcagtccagatttcaggagctaatggagtgggcagaagagcaacaacccaacatcgccgaggcccttaagcagagccctcctccagatatggctcagaaccttctcatggatcacctggccatctgcagtgaactggaggccaagcagatgctcctgaaatcgcttataaaggacgcagacagggtcatggcagatcttggtctcaatgagcgacaggtcatccagaaggctctctctgatgcacaaagccacgtgaattgtctcagtgacttagtgggccagcgaagaaagtacttaaacaaagccttgtccgagaaaacccagtttctcatggcagtgttccaggccaccagccaaattcagcaacatgagcgaaagataatgttccgtgaacacatctgtctgttaccagatgatgtgagcaaacaagtcaaaacatgtaagagtgcacaagccagcctcaagacttaccaaaatgaagtcactggactttgggcccagggtcgcgaactaatgaaggaagtcacagagcaggaaaagagtgaagtgctggggaagcttcaggaattgcagagtgtctatgacagtgttttacaaaagtgcagtcaccggttacaagaactagagaagaatttggtttctaggaagcattttaaggaagattttgataaagcttgccactggctaaaacaagcagatattgttacatttcctgaaatcaacctaatgaatgagagttctgagcttcatacacaactggctaaataccaaaacattcttgaacaatctccagaatatgaaaatcttctacttacgctgcagagaactgggcagaccatattaccatcgctgaatgaagtcgatcattcctacctcagtgaaaagctaaatgctttgcctcgacaatttaatgtaattgttgccttggctaaagacaagttctataaagtccaggaagcaattcttgctcggaaggaatatgcttccttgattgagttgacaacccagtctctgagtgaacttgaagcccaattcttgaggatgagcaaagttcccaccgacctggccgttgaggaggctctttctctgcaagatggttgcagagccattctggacgaggtggcgggccttggggaggcggtggatgaactgaaccagaaaaaagaaggttttcgcagcacaggtcagccttggcagccagacaagatgctgcaccttgtcaccttatatcacaggctgaagcgacaaacagaacagagggttagcttattagaagacaccaccagtgcttaccaagaacacgagaagatgtgccaacagctggagagacaactgaagtctgtaaaagaggagcagtccaaagtgaatgaggaaacgctgcctgcagaggagaagctcaaaatgtatcactccctggcaggaagtctccaggactcagggattgtactgaaacgagtaaccatacatcttgaagatcttgccccacaccttgaccccttggcttatgagaaagccaggcatcagatccagtcctggcaaggggagttaaaactgttgacttctgccattggtgagacggtgacagaatgtgagagccgaatggtgcagagtatagacttccagactgagatgagtcgctccctggactggctgaggagagtgaaggcagagctcagtgggccggtgtacctagacctcaacctgcaggacatccaagaggaaatcagaaaaatccaaattcatcaggaagaggtccagtccagcttgagaatcatgaatgcgctgagtcacaaggaaaaggagaagttcacaaaggccaaggagctgatttctgcggatttagaacacagcctcgctgagctctcagagctggatggagacatccaggaagccttacgcaccagacaggctaccttgactgaaatatatagccagtgtcaaaggtattatcaggtatttcaagcagccaatgactggcttgaggatgcccaagaattgttacagctggcaggcaatggcctagacgtggagagcgcagaggaaaatctcaaaagccacatggaatttttcagtacagaggatcagttccatagtaacctggaggagctccacagcctggtagccaccctggacccactcatcaagccaaccggcaaagaagacctagaacagaaagtggcttctctggaactcaggagccagaggatgagccgggactctggtgcccaagtggatctcttgcagagatgcacagctcaatggcacgattaccagaaagcaagggaagaggttattgaattgatgaatgatacagaaaagaaattgtctgagttttctttgttgaagacttcgtctagtcatgaagcggaagaaaaattgtcagaacacaaggctttagtgtcagtggttaactctttccatgagaaaattgtggcccttgaggaaaaagcttcacaactggagaaaaccggaaatgatgccagcaaagccaccctgagcaggtcaatgaccaccgtctggcagcgctggacacgccttcgagctgtggcccaggaccaggagaagatcctggaagatgcagtggatgagtggacgggctttaacaacaaggttaaaaaggccactgaaatgattgatcagctgcaagataagttacctggaagttcagcagagaaagcatcgaaagcagagctcttaactcttcttgaataccacgacacgttcgttctggagctggagcagcagcagtcggccttgggcatgctgcggcagcaaaccctgagcatgctccaggatggagccgccccaacccctggggaagagcctccgctcatgcaggaaatcaccgccatgcaagatcggtgcctgaacatgcaggagaaagtgaagactaatggaaagttggtgaagcaagagctgaaggaccgagaaatggtggagactcagatcaattctgtgaaatgttgggttcaggaaacgaaagaatatttagggaatccaacaatagaaatagatgctcaacttgaagaacttcagattctcctaacagaagccacaaatcaccgacagaacattgaaaaaatggcagaagaacagaaggagaagtacttaggtctttataccatattaccttctgaactctcccttcagttggctgaagtggcgttagatctaaagatccgagatcagatccaagacaaaataaaagaagttgagcagagcaaggccacgagccaggaactcagccggcaaattcagaagttagctaaagacctcacaactattctaactaagctgaaagcgaagacagataatgtagttcaagctaaaactgaccaaaaggtgctgggagaggaattagatggctgtaattcaaagttaatggaattagatgcagcagtacagaaattcttggaacagaatggccaactgggtaagccactggccaagaagataggaaaactgactgaacttcaccagcagaccattagacaagctgagaatcggctctccaagctcaatcaggcagcatcacatttagaagaatacaatgaaatgcttgaattaattttgaagtggattgaaaaagctaaagtcttggctcatggaactattgcatggaattctgcaagccagcttcgggaacaatatattttgcatcagaccctgctagaagaatccaaagaaattgacagtgagctggaagcaatgactgagaaattacagtacctcactagcgtgtactgtacagaaaaaatgtctcagcaagtggcagaactgggacgggagactgaggagttgcgacagatgatcaaaattcgtttgcagaacctccaagatgcagctaaggatatgaaaaaatttgaagcagagttgaaaaagttacaagctgccttggagcaagcccaggcaacactgacttctccagaagttggacgtctcagtctcaaggagcagctctctcatcggcagcatttgttgtctgagatggagtcactgaagccgaaggtgcaagcagtgcagctctgccagagtgccctccggatccccgaggatgtggttgccagcttacctctctgtcatgctgctctgcggctgcaggaagaggccagccggctgcagcacaccgccatccagcagtgtaacatcatgcaggaagctgtggtacaatatgaacaatatgagcaagaaatgaaacatctccagcaactgatagaaggagctcacagagagattgaggataaacctgttgccaccagtaacatacaggagctgcaggctcagatttctcggcatgaggagctggcgcagaaaattaagggctaccaggagcagatcgcttctttgaattccaagtgcaagatgctgacgatgaaagccaagcacgccaccatgctgctgacggtgaccgaggtcgaggggctggcggaagggacagaggacctggatggggagctcctccccacgccttcggcccacccctctgtggtcatgatgactgcaggtcgctgtcacactttgctgtcaccggtcactgaggagtctggggaggagggaaccaacagtgagatttcctctccacctgcctgtcgctccccttcacctgtggctaatacagatgcttctgttaaccaggacattgcatattaccaagccttgtctgctgagaggttgcagacagatgctgcaaaaattcaccccagcacatccgcatcccaggagttctatgaaccgggattggagccatccgctactgccaaactgggtgatttgcagcgttcttgggaaaccttaaagaatgtgatcagtgagaagcagcgcacactctatgaagctttggaacgccagcagaagtaccaggactccctccagtccatctctacgaagatggaggccattgagctgaaactcagtgagagcccagagcctggcaggagtccagaaagccagatggctgaacatcaggcattgatggatgagattctcatgctccaggatgaaatcaatgagctccagtcctctctcgcagaggagctggtatccgagtcttgtgaggccgaccctgcggagcagctggccttgcagtccacgctcactgtcttagccgagcgaatgtccaccatcaggatgaaagcctcggggaaacggcagcttttggaggagaagttgaatgatcagctggaggaacaaaggcaggaacaggccctgcagaggtatcgctgtgaagccgatgagctggacagctggctcttgagtaccaaggccactctggacactgcgctgagtccacccaaggagcccatggacatggaggcccagcttatggactgccagaatatgctggtggaaatagagcagaaggtggtggctttatcagaactgtcagtccacaatgagaacctgctgctggagggcaaagctcacaccaaggacgaggccgagcagctggctggaaagctgagaaggctcaaggggagcctgctggagctgcagagagccctgcatgataagcagctcaacatgcagggaacagcacaggagaaggaggagagcgatgttgacctaacagccacgcagagccccggcgtccaggaatggctggcccaagctcgcaccacatggacccagcagcggcagagcagtctccagcaacaaaaagagttagaacaggaattagccgagcagaagagtctccttcgctcagtagccagtcgtggagaggagattctaattcaacattcggcggcagagacctctggtgatgctggcgaaaaacctgatgtgttatcccaggagttggggatggaaggggagaaatcatccgctgaagaccagatgagaatgaaatgggaaagcctacatcaagaatttagtaccaagcagaaactactacagaatgttctggaacaggaacaagagcaagtgctttatagcaggccaaatcgactcttgtctggtgtgccactgtacaaaggggacgtgccaacccaagataaatctgcagttacatctttgctggatggactgaaccaagccttcgaggaggtttcatcccagagtggaggggcaaagaggcagagtatacacttggagcagaagttgtatgatggagtctcagccacctctacttggttggatgacgttgaagaacgtttatttgttgccacagcacttttaccagaagaaacagagacttgtctcttcaaccaagagattcttgccaaagacattaaggaaatgtctgaagaaatggataagaacaaaaacttgttttcccaagcttttccagagaatggtgataatcgagatgttattgaagatactttgggttgtcttttgggcaggttatccttgctagactcagtagtgaatcaacgatgtcatcagatgaaagaaagacttcagcaaatactaaatttccagaatgatctgaaagtgctgtttacatcactggctgacaacaaatacatcattctgcaaaaactggcaaatgtgtttgaacagcccgtagcagaacaaatagaggcaatacaacaggctgaagatggactcaaagaatttgatgcaggaatcattgaattaaagaggcgtggtgacaagctacaggtcgagcagccgtccatgcaagaactctccaagctccaggacatgtatgatgagctgatgatgatcattggctcccggaggagtggtctgaatcagaaccttacactcaagagtcagtatgagagggccctacaagatctggctgacctgctagaaactggtcaggagaagatggcaggagaccagaaaatcatcgtgtcttccaaagaggaaatccagcaactacttgacaaacataaggaatactttcagggcctggaatctcatatgatcttgactgaaacactcttcagaaagataatcagctttgcagtccaaaaggaaacccagttccatacagagctgatggctcaggcttctgctgtactgaaacgggctcacaagaggggtgtggagctggagtacattctagagacgtggtcccatctggatgaggaccagcaggagctcagcagacagctggaggtggtggaaagcagcatcccaagcgtgggtctggtggaggagaacgaggacaggcttattgaccgcataacactctaccagcatttaaaatctagccttaatgaataccagcccaaattatatcaagtattagatgatgggaaacgacttctgatatccatcagctgctcagatctagaaagccaactaaatcaacttggagagtgctggctaagtaacaccaataaaatgtctaaggaacttcacagactggaaacaatattgaaacactggaccagatatcaaagtgaatctgcagatctaattcactggttacaatctgcaaaagaccggctagaattttggactcagcaatctgtgacagtcccacaagagctggaaatggtccgtgatcatctaaatgctttcctggagttttctaaagaagtggatgcccaatcttccctgaaatcatctgttctgagtactggaaatcagctccttcgactaaaaaaggtggacacagccacgctgcgctctgagctgtcgcgcattgatagccagtggactgacctgctaaccaatatcccagccgtccaggagaagctccaccagctccagatggataaactgccttcccgccatgccatttctgaagtcatgagttggatttctctaatggaaaatgttattcagaaggatgaagataatattaaaaattccataggttacaaggcaattcatgaataccttcagaaatataagggttttaagatagacattaactgtaaacagctgacagtggattttgtgaaccagtccgtgctacaaatcagcagtcaggatgtggaaagtaagcgtagtgataagactgattttgctgagcaacttggagcaatgaataaaagttggcaaattctgcaaggtctagtaactgagaagatccagctgttggaaggcttattggaatcttggtcagaatatgaaaataatgtacaatgtctgaaaacatggtttgaaacccaggaaaagagactaaaacaacagcatcgaattggagatcaggcttctgttcaaaatgcactgaaagactgtcaggatctggaagatttgattaaagcaaaagaaaaagaagtagagaaaattgagcagaatggacttgctttgattcagaacaagaaagaagacgtctctagcattgtcatgagcacactgcgagagctcggccaaacctgggcaaatttagatcacatggttggacaattaaagatactgctgaaatcagtgcttgaccaatggagtagtcacaaagtggcctttgacaagataaacagttacctcatggaggccagatactctctttcccgattccgtctgctgactggctccttagaagctgtgcaagttcaggtggacaatcttcagaatctccaagatgatctggaaaaacaggaaaggagcttacagaaatttggctctatcaccaaccaattattaaaagagtgtcacccacccgtgacagaaactcttaccaatacactgaaagaagtcaacatgagatggaataacttgctggaagagattgctgagcagctacagtccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgacctcctcaaaggactgggcacagttaaagattccctcttttttctccatgagctgggagagcaactgaagcaacaagtggatgcttccgcagcatcagctattcaatcggatcaactctctttgagtcaacacttgtgtgccctggagcaagctctctgcaaacagcagacttcattacaggctggagttcttgattatgaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaaatgagcttggatataggttacccttgaatgataaggaaatcaaaagaatgcagaatctgaaccgccattggtctctgatctcctctcagactacagaaagattcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgagttgtttcaagccgagatgttcagtcgtcagcagattttgcactcaatcattattgatgggcaacgtcttctagaacaaggtcaagttgatgacagggatgaattcaacctgaaattgacactcctcagtaatcaatggcagggagtgattcgcagggcccagcagaggcgggggatcattgacagccagattcgccagtggcagcgctatagggagatggcagaaaagcttcgtaaatggttggttgaagtgtcctacctccccatgagtggtctcggaagtgttcctataccactgcaacaagcaaggaccctctttgatgaagtgcagttcaaagaaaaagtgtttctgcggcaacaaggcagctacatcctgactgtggaggctggcaagcaactccttctctcggcggacagtggcgctgaggccgccttgcaggccgaactcgctgaaatccaagagaaatggaaatcagccagcatgcggctggaagaacagaagaaaaaactagccttcttgttgaaagactgggaaaaatgtgagaaaggaatagcagattccctggagaaactacgaactttcaaaaagaagctttcgcagtctctcccggatcaccatgaagagctccatgcagaacaaatgcgttgcaaggaattagaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagcagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttggcttatcaggggaccacagtgccctagagtcacagatccgacaactgggcaaagccctggatgatagccgttttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacgccacgaggcaagtgtagtctctcacagcctggaccctctgtcagcagtccacatagcaggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaaagatatttatgtatgtacagtttgctaaagccaagttttgtttgtattgatttctttgcatttattatagatattataaaatagtt

SEQ ID NO: 29627 - DNA, 27436 bp, Homo sapiens
cggccgccggccgcagcgggctgagattgttgtcctctgtcaccagggcggctgggctcccgcagtcctgcagaccgcgcccgatcccggcgacagggcgggcggacagccgcgcatccccggggtcccgccgagcctgggcgcagagagccgggaggaagcgttcgctcgcttcgccttgctgctgggaaactgaacgaggccgagagagaaggttcttgagttcatgtaagaggacagtcttaaaacggaagaagaaaaagaagcagttcagtctttgggagagctgcctccttgttgagtgctgcaaaggcctggaattcatttatgacagaatagatctagaaaagtccaagcatgttttctagagtggtgtagccctgtgctgcctccagtgaagagtctcttggtgttggcttcgtgcttccggagggaccatggcaacctccagaggggcctcccggtgtcctcgggatatcgccaatgtgatgcagaggctgcaagatgagcaagagatagtacaaaaacgaactttcacaaaatggatcaactctcatctggccaagcggaaacctccaatggtggtggacgatctttttgaagacatgaaagatggtgttaaactgcttgcccttctggaggtcctgtctgggcagaaactgccttgtgaacaaggacgccggatgaagcgaatccatgctgtggctaacattggcacggcactcaagttcctcgaaggaagaaagtccatgcacagaggatcaccgattaaattagtcaacattaactccaccgatatagctgatggccgaccctcaatagttcttggattgatgtggaccattattctatatttccagattgaagagttgaccagcaacctgccccagctccagtctttgtccagcagcgcatcctccgtggacagcatagttagctctgagactcccagcccaccaagtaaacggaaggtgaccaccaagatccaaggaaatgctaagaaggctttattaaagtgggttcagtacacagctggcaagcagactggaatagaagtaaaagattttgggaagagttggagaagcggggttgcctttcattcagttattcatgccattcgaccggaattggtggacttggagacagtgaaaggcagatccaaccgagaaaatttggaggatgctttcactatcgccgaaacagaactggggatcccaagactgctagatcctgaagacgttgatgtggataaaccagatgagaaatctattatgacctatgtagcccagtttctgaaacattatcctgacatccacaatgcaagcactgatgggcaagaggatgatgaaatacttccaggtttcccatcttttgcaaattctgtacaaaattttaagagagaagacagagtaatttttaaggaaatgaaagtttggatagaacaatttgagagagatttgacaagagcacagatggtggaatcaaatttacaggataaatatcagtcatttaagcacttcagagttcaatatgaaatgaagaggaaacagattgaacatttaatacaaccattacacagagacggtaaattgtcacttgaccaagcattggtaaaacaatcttgggatagagtgacctccaggctctttgactggcatatacagcttgataaatctcttcctgcacctctgggcaccataggtgcctggctgtacagagcggaggtggccctgagagaggaaataaccgttcaacaggtccacgaggaaacagcaaacacgatacaacggaaacttgagcaacataaggatctgcttcaaaacacggatgcccacaaaagagcattccatgaaatctaccggaccaggtctgttaacgggattccagtgccacctgatcaattagaggacatggccgagaggtttcattttgtttcctccacatcagagctacacctaatgaaaatggaatttttagaattaaagtaccgtctgctctcactgctggttcttgcagagtcaaagctgaagtcttggatcattaagtacgggaggagagagtcagtggagcagcttctacaaaactacgtgtcttttatagaaaatagcaagttctttgaacaatatgaggtgacataccagatcttgaaacagacagctgagatgtatgtcaaagcagatggttcagtggaagaagctgagaatgtgatgaaattcatgaatgaaaccaccgctcagtggaggaatctctcagtagaagtgaggagtgtgaggagcatgctggaagaagtgatctctaactgggatcgctatggcaatacagtggctagtctgcaagcctggctagaggatgctgaaaaaatgctcaatcaatcagaaaatgccaaaaaggatttttttcgaaatttacctcattggattcagcagcatactgccatgaacgatgctggcaattttctaattgaaacctgtgatgagatggtttcccgtgacctgaagcagcaattactgttgctaaatgggcggtggagggagttgtttatggaagtcaagcaatatgctcaagctgatgagatggacagaatgaagaaggaatacacagactgtgttgttaccctgtctgcttttgcaacggaagcccataagaaactttctgaacccttagaagtctcttttatgaatgtcaagctattaattcaagacttggaggatattgagcagagggtgcctgtgatggatgcccaatacaagataattacaaagacagcacacctcattaccaaagaaagcccccaagaagaaggaaaagaaatgtttgcgaccatgtcaaagctcaaagagcagctaaccaaggtcaaagaatgttactccccactcctttatgagtctcagcagctgttgattccgttggaggaattagaaaagcagatgacgtccttttatgactcacttgggaaaatcaatgaaattatcacagttcttgagcgtgaggcacaatcgagtgccctttttaaacaaaaacatcaggaactgttagcttgtcaagaaaactgtaagaaaaccttgacacttattgagaaaggcagtcaaagtgttcaaaagtttgtgaccttgagcaacgtgttaaagcattttgatcagacgaggctacaaagacagattgcagatattcatgttgcttttcagagtatggtaaagaaaactggagattggaagaagcatgtggaaaccaacagtcgcttgatgaagaagtttgaggagtctcgagcagagttggagaaggtactgcggattgctcaggagggcctggaggaaaagggggatccagaggagctcctgcggagacacactgagtttttcagtcagctggatcagagggtgctcaatgctttcctgaaagcttgtgatgaactcaccgacatccttccagagcaggagcagcaggggctgcaggaagctgttcgaaagctccacaaacaatggaaggatcttcaaggagaagccccttatcatttgcttcatctgaagattgatgtggagaagaataggttcttagcctctgtagaagaatgcagaactgagctggatcgagagaccaagctgatgccccaggaaggcagtgaaaagataattaaagagcacagggttttcttcagtgacaaaggtcctcatcatctctgtgagaaaaggttacagctcatcgaggaactctgtgtgaaactcccagtgcgggacccagtaagggacacacctggaacctgtcacgtgactctcaaagagctcagagctgccattgacagcacctacaggaagctcatggaagacccagacaagtggaaggactacactagcagattctctgagttctcatcttggatatctacaaatgagacacaattaaaggggatcaagggtgaggccatcgatactgccaaccacggagaggttaaacgtgccgttgaagagatcagaaatggtgttaccaaaaggggtgagaccctcagctggctgaaatccaggctgaaagttttgacagaagtttcttctgagaatgaagcccaaaagcagggagatgagctggcaaaattatccagctctttcaaggctcttgtgacgctgctgtcagaggttgaaaagatgctaagcaattttggggactgtgtccagtacaaagaaatagtcaaaaattctctcgaagaattaatttctggctctaaagaagtccaggaacaagctgagaagatcttggatactgaaaatctgtttgaagcacagcagttacttcttcatcaccagcaaaagacaaagcggatctcagcaaagaagagagatgtgcagcagcagatcgcgcaggcgcagcagggagaaggggggctgcctgaccgaggccacgaggagctgcggaagctggagagcacactggatggcctggagcgcagccgggagaggcaggaacgccgcatccaggtcacattaagaaaatgggagcgatttgaaacaaacaaagaaacagtagtaagatacctttttcaaacaggttccagtcatgaacgcttcttgagttttagcagtttggaaagtttatcttcagaactggaacaaacaaaggagttttctaaacggacagaaagtattgcagtccaggctgagaaccttgtaaaggaagcttcagagataccgcttgggccccaaaataagcagctgcttcaacagcaggccaagtcaatcaaagaacaagtcaaaaaattagaagacacgcttgaagaagatattaaaaccatggaaatggtgaaaaccaagtgggatcattttggcagtaattttgagactctgtccgtctggataactgagaaagaaaaagaactcaatgccttggaaacttcgtcatctgccatggacatgcaaatcagccaaattaaggtcacaattcaggaaatagaaagtaagctcagcagcattgtaggattagaagaagaagcccagtcttttgctcagtttgttaccactggagaatctgctcgaattaaagccaagttgacacaaataagaagatacggggaagagcttcgagagcatgcacagtgtctggaaggaacaatcctgggacatttatctcagcagcaaaagtttgaagagaaccttagaaagatccagcaatctgtgtctgaatttgaagataaacttgctgttccaattaaaatatgttcttcagctacagaaacatacaaagttcttcaagaacatatggatctctgccaggccctggagtcactgagcagcgcgatcactgccttctcagccagtgccaggaaggttgtgaacagagattcctgtgttcaggaggctgcggctctacagcagcaatacgaggacatcctaaggagggcgaaggagagacagacggcgctggagaatctgctggcccactggcagaggctagagaaagaactatcatcctttttgacctggttagagcggggtgaagctaaagccagttccccagaaatggacatttctgcagacagagtcaaagtggaaggtgaacttcagttaatacaggcactgcaaaatgaagttgtatcccaggcctcattctatagcaaacttttgcaattgaaggaatcattgttctcagtagcctccaaagatgatgtgaaaatgatgaaactacatttggagcagttggatgagagatggagagatttaccacagatcattaacaaaaggattaattttcttcagtctgtggttgctgaacaccagcaatttgatgagctgctgctttccttttctgtctggattaaactgtttctcagtgaattacaaactacctctgagattagcataatggaccatcaagtagcccttactcggcataaggaccacgcagcagaagtagagagcaaaaagggcgaattgcagagtctgcagggtcacttagcaaagttgggttctctgggccgtgctgaggacctccacctcctgcagggaaaggctgaggactgcttccagctgtttgaggaggccagccaggttgtggagaggcggcagcttgccctgtcccatttggcagaattcctccagagccatgcctctctgtccggcattctccgccagctgaggcaaacagtggaagcaaccaacagtatgaataagaacgagtctgatttgatagaaaaggacctcaatgatgctcttcaaaatgctaaagcattagaatctgctgccgtcagtctggatggcattctttccaaagcccaataccatctgaaaatcgggagctctgagcaaaggacttcctgcagagccacggctgatcagctctgtggagaggtagagaggatccagaaccttctgggaaccaagcagagtgaggcagatgctctggcagtgttgaaaaaagcattccaagaccagaaagaggagcttctgaaaagcattgaggacattgaagaaaggactgacaaagagcgattgaaagaacctacccgccaagctcttcagcagaggttaagagtgtttaatcagctagaagatgaattgaattctcacgagcatgaactatgttggttgaaagacaaagccaagcaaattgcccagaaagatgtagcttttgcacctgaagttgacagggagataaaccgcttagaggtcacctgggatgataccaaaagactaattcatgaaaatcagggtcagtgctgtggacttattgacttaatgagagaatatcagaacctgaaatcagctgtatctaaagtcttagaaaatgccagcagtgtgattgtaaccagaactaccataaaagatcaggaggatcttaaatgggctttttccaagcatgaaactgccaagaacaaaatgaattacaaacagaaagacttggataactttaccagcaaaggaaaacacttgttatctgagctgaagaaaattcacagtagtgatttcagcttggtgaaaacagacatggagagcaccgtggacaaatggctggatgtatcagagaaacttgaagaaaacatggataggctgagagtaagcctgtccatttgggatgatgtactgtcaactagagatgagattgagggatggtcaaacaactgcgttccacagatggcagaaaacatcagcaacctggataaccacctcagagctgaagaactgcttaaagaatttgagtctgaagttaaaaacaaagcattgagattggaagaactgcattccaaagttaatgatctgaaagaattaactaaaaatctagaaacaccgccagaccttcagtttatagaagcagacttaatgcagaaactggagcatgccaaagaaataactgaagtagcaaaaggaaccctgaaggatttcacggctcaaagtacacaagtggagaagtttattaatgacataacaacatggttcacaaaagtggaagaatcgttgatgaactgtgcccaaaatgagacttgtgaagcattgaaaaaagtcaaggatatacaaaaagaacttcaaagtcaacaaagcaacatcagctctacccaagaaaatctcaatagcttgtgccgcaagtaccactcagctgagttggagagcctgggccgtgcaatgactggtctgataaagaaacatgaagccgtgagccagttgtgctccaaaacccaggccagcctgcaggaatctctggaaaaacacttcagtgagtctatgcaggaattccaagaatggtttttgggagcaaaggcagcagcaaaagaatcatcagatcgcaccggtgacagcaaagttctagaagcaaagctccatgatcttcagaacattttggactcagtcagtgatgggcagagcaaacttgatgcagtgactcaagaaggacaaactttgtatgcacatttgtctaaacaaattgtcagtagcattcaagaacaaatcacaaaggccaatgaagagtttcaagcatttctgaaacaatgccttaaagataagcaggctcttcaagactgtgcttcagaacttggaagctttgaagatcagcacagaaaactgaacttatggatccatgaaatggaagaaaggttcaatacggaaaacttgggagagagtaaacagcacattcctgagaagaaaaatgaagttcataaagttgaaatgtttttgggagaactgctggctgcaagagagtctcttgataagctttcccagagagggcagcttctgagtgaagaaggccacggtgctgggcaggagggccgcctgtgttcccagctcctcacaagccaccagaacctacttagaatgaccaaagagaaactccggagctgccaggtggcccttcaggagcacgaagccctggaggaagcactgcaaagcatgtggttctgggtgaaggccattcaggacagactggcctgtgcagagagcactcttgggagcaaagacaccctggagaaacggctgtcacaaatacaggatattctcctgatgaaaggtgaaggggaagttaagttgaatatggccattggcaagggggaacaggccttgagaagtagcaacaaagaaggtcagagggtgattcagactcagttagagacccttaaagaagtgtgggctgacatcatgagctcctccgtccacgctcaaagcactttagagtctgtgattagccaatggaatgactatgtagagaggaaaaaccagttggagcagtggatggaatcagtggatcaaaaaatagaacatcccttacaaccacagccaggtctgaaagagaagttcgtcctgcttgaccacctccagtccatcctgtctgaggcagaagatcacacgagagcccttcaccgtctaattgcgaagtccagggagctctacgaaaagacagaggatgagtctttcaaggacacagctcaagaggagctgaaaacacagtttaatgatataatgactgttgccaaggaaaaaatgaggaaagtggaagagattgtgaaagatcatctaatgtatttagatgcggtccacgagttcacagattggctccattcagcaaaggaagaacttcaccggtggtcagatatgtctggagattcatcagccacccagaaaaagttatcaaaaattaaggagctgatagattccagagagattggtgcaagccgtctcagcagagtggagtcgctggctcccgaagtgaaacagaacacaactgccagtgggtgtgagctcatgcacacggagatgcaggccctgcgtgccgactggaagcagtgggaagacagtgtattccaaacgcagagctgtttggagaacctggtcagccagatggccctttcggagcaggaattctcaggccaagtggctcaactggagcaggccctggaacagttcagtgcccttctgaaaacctgggctcagcagttaaccctcctggaaggcaagaacacggatgaggagatagtggaatgctggcacaaaggacaagagatactggatgctttgcaaaaagcagagcctagaacagaggatctcaagtctcagctgaatgaactttgtcgattttccagagacctgagtacctacagtggaaaagtttctggcttgattaaagagtataattgtctttgtttgcaagcatccaagggctgccagaataaagaacagattttacagcaaagatttcgaaaggccttcagggatttccagcagtggttggttaatgcaaaaatcactaccgccaagtgttttgatatacctcaaaatataagtgaagtttcaactagtcttcagaaaatacaggagtttttgtcagaaagtgaaaatggacagcacaagctaaacatgatgctgtctaaaggggaacttctgagtaccctgctgaccaaagagaaagcgaaagggatccaggccaaagttacagctgcaaaagaagattggaaaaattttcattcaaatctccaccaaaaagaatctgctctagagaatctaaagatccaaatgaaggactttgaagtaagtgctgagcctatccaggactggctgagtaaaactgagaagatggtccatgaaagcagcaatcgcctctatgatctgccagcaaagaggagggagcagcagaagctccagtctgtccttgaggaaatacactgctacgagcctcagctcaacaggctgaaagagaaagctcagcagctgtgggaaggacaagctgccagcaagagctttaggcacagagtgtcgcagctgtcttctcagtatctagcgctaagcaatttaacaaaggagaaagtgtcaagactggatagaatcgttgcagaacacaatcagttctctcttgggattaaagaattacaagactggatgacggatgcgattcacatgctggattcatactgccacccgacatccgacaaaagtgtgctggacagcaggacgctcaagctcgaggctctattatcagtcaaacaggaaaaagagattcagatgaaaatgatagtgaccaggggagaatctgtccttcagaatacttctccagaaggcattcccactattcagcagcagctgcagagtgtgaaggatatgtgggcatcccttttgtctgcagggattcgttgtaaaagccaactcgaaggagctctctccaagtggacaagttatcaggatggcgttcgacagttctccggttggatggatagtatggaagccaacctgaatgaatcagaaaggcagcatgcggagctgcgggataaaacaacgatgctcggaaaagccaagttattaaatgaagaagtgctgagttacagcagcttgctggagaccatcgaagtcaaaggggctggcatgacagaacactatgtcacccagctagaactccaggatctacaggaacgatacagagccatccaagagagggccaaggaagccgtaaccaagtctgaaaaacttgtccgcctgcaccaagagtatcagagagacctaaaggcatttgaagtttggttggggcaagaacaagaaaagctcgaccagtattcagttcttgaaggtgatgcccacactcatgagacaacattgcgtgatcttcaggagctacaggtacactgtgcagaggggcaggccctgttgaactcagtgctgcacaccagagaggatgtgatcccatcaggtatcccacaggcagaggaccgggctttagagtctctccggcaagactggcaggcttaccagcacaggctgtccgagactcgaactcagttcaataacgtggtgaacaaattgaggctaatggagcaaaagtttcagcaagtagatgaatggctcaaaacagcagaggagaaaaagtggcacgaagaagtgactgcatacagagatgaagttgaggaagtgggagctagagctcaggagatactggacgagagccacgtgaacagcagaatgggttgccaggccacccagctgacttccagataccaggccctgcttctccaagtgctggaacaaataaaattcctggaggaggagattcagagtttggaggaatcagaatcatccctcagttcctattctgattggtatggctctactcataaaaacttcaagaatgtggctaccaagattgacaaagtagatacagtaatgatggggaagaaattgaagacgttggaggttttgctcaaagacatggagaaaggtcacagtttgctgaaatcagcccgggagaaaggagagagggctgttaaatacttggaggaaggcgaggcagagaggttaagaaaggagattcatgatcacatggagcagttgaaggaactgaccagcactgtccggaaagaacacatgacgctggaaaaaggtcttcatttagcaaaggaattctcagataaatgcaaagcactgacacagtggatagcagaataccaggaaattctacatgttcctgaagaacccaaaatggaattatatgagaaaaaagctcagttatctaaatacaagtcacttcaacaaacggtgctgtcccatgaaccatcagtaaagtcagtgagagagaagggtgaagctcttttggaactggtgcaggacgtcactttaaaggacaaaatagatcaacttcaaagtgattaccaggacctgtgcagcataggaaaggcaatgatggaagaaattgctggttttgaagaccgtttgaacaatcttcaaatgaaaggtgatactttgattggccaatgtgcagaccacctgcaagcgaaacttaaacaaaacgtgcatgctcatctgcagggcacaaaggacagctactcagcgatctgcagcacagctcagaggatgtaccagagtttggaacacgaacttcagaagcacgtcagccgacaagacaccctgcagcagtgccaggcctggctttctgcagtccagccggatttagagccaagtcctcaaccacctcttagtagggcagaagccattaagcaggtcaaacacttcagagctttgcaagagcaggcaaggacctacctagatctcctttgctccatgtgtgacctgtcaaatgcttcggtgaaaaccacagcaaaagacattcaacaaacagagcaaacgattgaacaaaagcttgtccaggcccagaacttaactcagggctgggaagagatcaagcacctgaagtctgagctctggatttacctgcaagatgctgatcagcaactgcagaacatgaagaggaggcactctgagctggagctgaacattgcacagaacatggtttcacaagttaaggattttgttaagaaactacagagcaaacaggcatccgtgaacaccataatagaaaaggtgaataagttaacaaagaaggaggaatcgcctgaacacaaggaaataaatcatttaaatgatcagtggctcgatttgtgccgtcagtctaacaacctgtgcttgcaaagggaagaggatcttcagagaacaagagattaccatgactgtatgaatgttgttgaagtgttcctagaaaaatttactacagaatgggataacttggccagatctgatgcagagagtacagctgtccacctggaagctttgaaaaagttagcattggcattgcaggagagaaagtatgctattgaagatctgaaagatcaaaagcagaaaatgatagagcatctgaatttagatgacaaggagttagtcaaagaacagacgagtcatttagagcaacgttggtttcagcttgaggacctcattaaaaggaaaatccaagtgtcagtcaccaacttggaggagttaaatgtggtgcagtccagatttcaggagctaatggagtgggcagaagagcaacaacccaacatcgccgaggcccttaagcagagccctcctccagatatggctcagaaccttctcatggatcacctggccatctgcagtgaactggaggccaagcagatgctcctgaaatcgcttataaaggacgcagacagggtcatggcagatcttggtctcaatgagcgacaggtcatccagaaggctctctctgatgcacaaagccacgtgaattgtctcagtgacttagtgggccagcgaagaaagtacttaaacaaagccttgtccgagaaaacccagtttctcatggcagtgttccaggccaccagccaaattcagcaacatgagcgaaagataatgttccgtgaacacatctgtctgttaccagatgatgtgagcaaacaagtcaaaacatgtaagagtgcacaagccagcctcaagacttaccaaaatgaagtcactggactttgggcccagggtcgcgaactaatgaaggaagtcacagagcaggaaaagagtgaagtgctggggaagcttcaggaattgcagagtgtctatgacagtgttttacaaaagtgcagtcaccggttacaagaactagagaagaatttggtttctaggaagcattttaaggaagattttgataaagcttgccactggctaaaacaagcagatattgttacatttcctgaaatcaacctaatgaatgagagttctgagcttcatacacaactggctaaataccaaaacattcttgaacaatctccagaatatgaaaatcttctacttacgctgcagagaactgggcagaccatattaccatcgctgaatgaagtcgatcattcctacctcagtgaaaagctaaatgctttgcctcgacaatttaatgtaattgttgccttggctaaagacaagttctataaagtccaggaagcaattcttgctcggaaggaatatgcttccttgattgagttgacaacccagtctctgagtgaacttgaagcccaattcttgaggatgagcaaagttcccaccgacctggccgttgaggaggctctttctctgcaagatggttgcagagccattctggacgaggtggcgggccttggggaggcggtggatgaactgaaccagaaaaaagaaggttttcgcagcacaggtcagccttggcagccagacaagatgctgcaccttgtcaccttatatcacaggctgaagcgacaaacagaacagagggttagcttattagaagacaccaccagtgcttaccaagaacacgagaagatgtgccaacagctggagagacaactgaagtctgtaaaagaggagcagtccaaagtgaatgaggaaacgctgcctgcagaggagaagctcaaaatgtatcactccctggcaggaagtctccaggactcagggattgtactgaaacgagtaaccatacatcttgaagatcttgccccacaccttgaccccttggcttatgagaaagccaggcatcagatccagtcctggcaaggggagttaaaactgttgacttctgccattggtgagacggtgacagaatgtgagagccgaatggtgcagagtatagacttccagactgagatgagtcgctccctggactggctgaggagagtgaaggcagagctcagtgggccggtgtacctagacctcaacctgcaggacatccaagaggaaatcagaaaaatccaaattcatcaggaagaggtccagtccagcttgagaatcatgaatgcgctgagtcacaaggaaaaggagaagttcacaaaggccaaggagctgatttctgcggatttagaacacagcctcgctgagctctcagagctggatggagacatccaggaagccttacgcaccagacaggctaccttgactgaaatatatagccagtgtcaaaggtattatcaggtatttcaagcagccaatgactggcttgaggatgcccaagaattgttacagctggcaggcaatggcctagacgtggagagcgcagaggaaaatctcaaaagccacatggaatttttcagtacagaggatcagttccatagtaacctggaggagctccacagcctggtagccaccctggacccactcatcaagccaaccggcaaagaagacctagaacagaaagtggcttctctggaactcaggagccagaggatgagccgggactctggtgcccaagtggatctcttgcagagatgcacagctcaatggcacgattaccagaaagcaagggaagaggttattgaattgatgaatgatacagaaaagaaattgtctgagttttctttgttgaagacttcgtctagtcatgaagcggaagaaaaattgtcagaacacaaggctttagtgtcagtggttaactctttccatgagaaaattgtggcccttgaggaaaaagcttcacaactggagaaaaccggaaatgatgccagcaaagccaccctgagcaggtcaatgaccaccgtctggcagcgctggacacgccttcgagctgtggcccaggaccaggagaagatcctggaagatgcagtggatgagtggacgggctttaacaacaaggttaaaaaggccactgaaatgattgatcagctgcaagataagttacctggaagttcagcagagaaagcatcgaaagcagagctcttaactcttcttgaataccacgacacgttcgttctggagctggagcagcagcagtcggccttgggcatgctgcggcagcaaaccctgagcatgctccaggatggagccgccccaacccctggggaagagcctccgctcatgcaggaaatcaccgccatgcaagatcggtgcctgaacatgcaggagaaagtgaagactaatggaaagttggtgaagcaagagctgaaggaccgagaaatggtggagactcagatcaattctgtgaaatgttgggttcaggaaacgaaagaatatttagggaatccaacaatagaaatagatgctcaacttgaagaacttcagattctcctaacagaagccacaaatcaccgacagaacattgaaaaaatggcagaagaacagaaggagaagtacttaggtctttataccatattaccttctgaactctcccttcagttggctgaagtggcgttagatctaaagatccgagatcagatccaagacaaaataaaagaagttgagcagagcaaggccacgagccaggaactcagccggcaaattcagaagttagctaaagacctcacaactattctaactaagctgaaagcgaagacagataatgtagttcaagctaaaactgaccaaaaggtgctgggagaggaattagatggctgtaattcaaagttaatggaattagatgcagcagtacagaaattcttggaacagaatggccaactgggtaagccactggccaagaagataggaaaactgactgaacttcaccagcagaccattagacaagctgagaatcggctctccaagctcaatcaggcagcatcacatttagaagaatacaatgaaatgcttgaattaattttgaagtggattgaaaaagctaaagtcttggctcatggaactattgcatggaattctgcaagccagcttcgggaacaatatattttgcatcagaccctgctagaagaatccaaagaaattgacagtgagctggaagcaatgactgagaaattacagtacctcactagcgtgtactgtacagaaaaaatgtctcagcaagtggcagaactgggacgggagactgaggagttgcgacagatgatcaaaattcgtttgcagaacctccaagatgcagctaaggatatgaaaaaatttgaagcagagttgaaaaagttacaagctgccttggagcaagcccaggcaacactgacttctccagaagttggacgtctcagtctcaaggagcagctctctcatcggcagcatttgttgtctgagatggagtcactgaagccgaaggtgcaagcagtgcagctctgccagagtgccctccggatccccgaggatgtggttgccagcttacctctctgtcatgctgctctgcggctgcaggaagaggccagccggctgcagcacaccgccatccagcagtgtaacatcatgcaggcagctgtggtacaatatgaacaatatgagcaagaaatgaaacatctccagcaactgatagaaggagctcacagagagattgaggataaacctgttgccaccagtaacatacaggagctgcaggctcagatttctcggcatgaggagctggcgcagaaaattaagggctaccaggagcagatcgcttctttgaattccaagtgcaagatgctgacgatgaaagccaagcacgccaccatgctgctgacggtgaccgaggtcgaggggctggcggaagggacagaggacctggatggggagctcctccccacgccttcggcccacccctctgtggtcatgatgactgcaggtcgctgtcacactttgctgtcaccggtcactgaggagtctggggaggagggaaccaacagtgagatttcctctccacctgcctgtcgctccccttcacctgtggctaatacagatgcttctgttaaccaggacattgcatattaccaagccttgtctgctgagaggttgcagacagatgctgcaaaaattcaccccagcacatccgcatcccaggagttctatgaaccgggattggagccatccgctactgccaaactgggtgatttgcagcgttcttgggaaaccttaaagaatgtgatcagtgagaagcagcgcacactctatgaagctttggaacgccagcagaagtaccaggactccctccagtccatctctacgaagatggaggccattgagctgaaactcagtgagagcccagagcctggcaggagtccagaaagccagatggctgaacatcaggcattgatggatgagattctcatgctccaggatgaaatcaatgagctccagtcctctctcgcagaggagctggtatccgagtcttgtgaggccgaccctgcggagcagctggccttgcagtccacgctcactgtcttagccgagcgaatgtccaccatcaggatgaaagcctcggggaaacggcagcttttggaggagaagttgaatgatcagctggaggaacaaaggcaggaacaggccctgcagaggtatcgctgtgaagccgatgagctggacagctggctcttgagtaccaaggccactctggacactgcgctgagtccacccaaggagcccatggacatggaggcccagcttatggactgccagaatatgctggtggaaatagagcagaaggtggtggctttatcagaactgtcagtccacaatgagaacctgctgctggagggcaaagctcacaccaaggacgaggccgagcagctggctggaaagctgagaaggctcaaggggagcctgctggagctgcagagagccctgcatgataagcagctcaacatgcagggaacagcacaggagaaggaggagagcgatgttgacctaacagccacgcagagccccggcgtccaggaatggctggcccaagctcgcaccacatggacccagcagcggcagagcagtctccagcaacaaaaagagttagaacaggaattagccgagcagaagagtctccttcgctcagtagccagtcgtggagaggagattctaattcaacattcggcggcagagacctctggtgatgctggcgaaaaacctgatgtgttatcccaggagttggggatggaaggggagaaatcatccgctgaagaccagatgagaatgaaatgggaaagcctacatcaagaatttagtaccaagcagaaactactacagaatgttctggaacaggaacaagagcaagtgctttatagcaggccaaatcgactcttgtctggtgtgccactgtacaaaggggacgtgccaacccaagataaatctgcagttacatctttgctggatggactgaaccaagccttcgaggaggtttcatcccagagtggaggggcaaagaggcagagtatacacttggagcagaagttgtatgatggagtctcagccacctctacttggttggatgacgttgaagaacgtttatttgttgccacagcacttttaccagaagaaacagagacttgtctcttcaaccaagagattcttgccaaagacattaaggaaatgtctgaagaaatggataagaacaaaaacttgttttcccaagcttttccagagaatggtgataatcgagatgttattgaagatactttgggttgtcttttgggcaggttatccttgctagactcagtagtgaatcaacgatgtcatcagatgaaagaaagacttcagcaaatactaaatttccagaatgatctgaaagtgctgtttacatcactggctgacaacaaatacatcattctgcaaaaactggcaaatgtgtttgaacagcccgtagcagaacaaatagaggcaatacaacaggctgaagatggactcaaagaatttgatgcaggaatcattgaattaaagaggcgtggtgacaagctacaggtcgagcagccgtccatgcaagaactctccaagctccaggacatgtatgatgagctgatgatgatcattggctcccggaggagtggtctgaatcagaaccttacactcaagagtcagtatgagagggccctacaagatctggctgacctgctagaaactggtcaggagaagatggcaggagaccagaaaatcatcgtgtcttccaaagaggaaatccagcaactacttgacaaacataaggaatactttcagggcctggaatctcatatgatcttgactgaaacactcttcagaaagataatcagctttgcagtccaaaaggaaacccagttccatacagagctgatggctcaggcttctgctgtactgaaacgggctcacaagaggggtgtggagctggagtacattctagagacgtggtcccatctggatgaggaccagcaggagctcagcagacagctggaggtggtggaaagcagcatcccaagcgtgggtctggtggaggagaacgaggacaggcttattgaccgcataacactctaccagcatttaaaatctagccttaatgaataccagcccaaattatatcaagtattagatgatgggaaacgacttctgatatccatcagctgctcagatctagaaagccaactaaatcaacttggagagtgctggctaagtaacaccaataaaatgtctaaggaacttcacagactggaaacaatattgaaacactggaccagatatcaaagtgaatctgcagatctaattcactggttacaatctgcaaaagaccggctagaattttggactcagcaatctgtgacagtcccacaagagctggaaatggtccgtgatcatctaaatgctttcctggagttttctaaagaagtggatgcccaatcttccctgaaatcatctgttctgagtactggaaatcagctccttcgactaaaaaaggtggacacagccacgctgcgctctgagctgtcgcgcattgatagccagtggactgacctgctaaccaatatcccagccgtccaggagaagctccaccagctccagatggataaactgccttcccgccatgccatttctgaagtcatgagttggatttctctaatggaaaatgttattcagaaggatgaagataatattaaaaattccataggttacaaggcaattcatgaataccttcagaaatataagggttttaagatagacattaactgtaaacagctgacagtggattttgtgaaccagtccgtgctacaaatcagcagtcaggatgtggaaagtaagcgtagtgataagactgattttgctgagcaacttggagcaatgaataaaagttggcaaattctgcaaggtctagtaactgagaagatccagctgttggaaggcttattggaatcttggtcagaatatgaaaataatgtacaatgtctgaaaacatggtttgaaacccaggaaaagagactaaaacaacagcatcgaattggagatcaggcttctgttcaaaatgcactgaaagactgtcaggatctggaagatttgattaaagcaaaagaaaaagaagtagagaaaattgagcagaatggacttgctttgattcagaacaagaaagaagacgtctctagcattgtcatgagcacactgcgagagctcggccaaacctgggcaaatttagatcacatggttggacaattaaagatactgctgaaatcagtgcttgaccaatggagtagtcacaaagtggcctttgacaagataaacagttacctcatggaggccagatactctctttcccgattccgtctgctgactggctccttagaagctgtgcaagttcaggtggacaatcttcagaatctccaagatgatctggaaaaacaggaaaggagcttacagaaatttggctctatcaccaaccaattattaaaagagtgtcacccacccgtgacagaaactcttaccaatacactgaaagaagtcaacatgagatggaataacttgctggaagagattgctgagcagctacagtccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgacctcctcaaaggactgggcacagttaaagattccctcttttttctccatgagctgggagagcaactgaagcaacaagtggatgcttccgcagcatcagctattcaatcggatcaactctctttgagtcaacacttgtgtgccctggagcaagctctctgcaaacagcagacttcattacaggctggagttcttgattatgaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaaatgagcttggatataggttacccttgaatgataaggaaatcaaaagaatgcagaatctgaaccgccattggtctctgatctcctctcagactacagaaagattcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgagttgtttcaagccgagatgttcagtcgtcagcagattttgcactcaatcattattgatgggcaacgtcttctagaacaaggtcaagttgatgacagggatgaattcaacctgaaattgacactcctcagtaatcaatggcagggagtgattcgcagggcccagcagaggcgggggatcattgacagccagattcgccagtggcagcgctatagggagatggcagaaaagcttcgtaaatggttggttgaagtgtcctacctccccatgagtggtctcggaagtgttcctataccactgcaacaagcaaggaccctctttgatgaagtgcagttcaaagaaaaagtgtttctgcggcaacaaggcagctacatcctgactgtggaggctggcaagcaactccttctctcggcggacagtggcgctgaggccgccttgcaggccgaactcgctgaaatccaagagaaatggaaatcagccagcatgcggctggaagaacagaagaaaaaactagccttcttgttgaaagactgggaaaaatgtgagaaaggaatagcagattccctggagaaactacgaactttcaaaaagaagctttcgcagtctctcccggatcaccatgaagagctccatgcagaacaaatgcgttgcaaggaattagaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagcagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttggcttatcagatgtaatgatccccgaaagccctgaggcctatgtaaaactcacagaaaatgcaatcaaaaatacctccggggaccacagtgccctagagtcacagatccgacaactgggcaaagccctggatgatagccgttttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacgccacgaggcaagtgtagtctctcacagcctggaccctctgtcagcagtccacatagcaggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaaagatatttatgtatgtacagtttgctaaagccaagttttgtttgtattgatttctttgcatttattatagatattataaaata

SEQ ID NO: 29628 - DNA, 27601 bp, Homo sapiens
cccgggcagtggaaaccgtgggcaaaagttagctggcaggacagcgcagctcctccaggcagcggaggcagcgcgtcccggctctcagggacatttccttcccacctcgacccccgggaggtggtcccggtataaaggctcgctgagcgggtgggtcacagcacagctttgcagctgcggagaaacgcccaaggccgtgcatctccaggagggcggctgggctcccgcagtcctgcagaccgcgcccgatcccggcgacagggcgggcggacagccgcgcatccccggggtcccgccgagcctgggcgcagagagccgggaggaagcgttcgctcgcttcgccttgctgctgggaaactgaacgaggccgagagagaaggttcttgagttcatgtaagaggacagtcttaaaacggaagaagaaaaagaagcagttcagtctttgggagagctgcctccttgttgagtgctgcaaaggcctggaattcatttatgacagaatagatctagaaaagtccaagcatgttttctagagtggtgtagccctgtgctgcctccagtgaagagtctcttggtgttggcttcgtgcttccggagggaccatggcaacctccagaggggcctcccggtgtcctcgggatatcgccaatgtgatgcagaggctgcaagatgagcaagagatagtacaaaaacgaactttcacaaaatggatcaactctcatctggccaagcggaaacctccaatggtggtggacgatctttttgaagacatgaaagatggtgttaaactgcttgcccttctggaggtcctgtctgggcagaaactgccttgtgaacaaggacgccggatgaagcgaatccatgctgtggctaacattggcacggcactcaagttcctcgaaggaagaaagtccatgcacagaggatcaccgattaaattagtcaacattaactccaccgatatagctgatggccgaccctcaatagttcttggattgatgtggaccattattctatatttccagattgaagagttgaccagcaacctgccccagctccagtctttgtccagcagcgcatcctccgtggacagcatagttagctctgagactcccagcccaccaagtaaacggaaggtgaccaccaagatccaaggaaatgctaagaaggctttattaaagtgggttcagtacacagctggcaagcagactggaatagaagtaaaagattttgggaagagttggagaagcggggttgcctttcattcagttattcatgccattcgaccggaattggtggacttggagacagtgaaaggcagatccaaccgagaaaatttggaggatgctttcactatcgccgaaacagaactggggatcccaagactgctagatcctgaagacgttgatgtggataaaccagatgagaaatctattatgacctatgtagcccagtttctgaaacattatcctgacatccacaatgcaagcactgatgggcaagaggatgatgaaatacttccaggtttcccatcttttgcaaattctgtacaaaattttaagagagaagacagagtaatttttaaggaaatgaaagtttggatagaacaatttgagagagatttgacaagagcacagatggtggaatcaaatttacaggataaatatcagtcatttaagcacttcagagttcaatatgaaatgaagaggaaacagattgaacatttaatacaaccattacacagagacggtaaattgtcacttgaccaagcattggtaaaacaatcttgggatagagtgacctccaggctctttgactggcatatacagcttgataaatctcttcctgcacctctgggcaccataggtgcctggctgtacagagcggaggtggccctgagagaggaaataaccgttcaacaggtccacgaggaaacagcaaacacgatacaacggaaacttgagcaacataaggatctgcttcaaaacacggatgcccacaaaagagcattccatgaaatctaccggaccaggtctgttaacgggattccagtgccacctgatcaattagaggacatggccgagaggtttcattttgtttcctccacatcagagctacacctaatgaaaatggaatttttagaattaaagtaccgtctgctctcactgctggttcttgcagagtcaaagctgaagtcttggatcattaagtacgggaggagagagtcagtggagcagcttctacaaaactacgtgtcttttatagaaaatagcaagttctttgaacaatatgaggtgacataccagatcttgaaacagacagctgagatgtatgtcaaagcagatggttcagtggaagaagctgagaatgtgatgaaattcatgaatgaaaccaccgctcagtggaggaatctctcagtagaagtgaggagtgtgaggagcatgctggaagaagtgatctctaactgggatcgctatggcaatacagtggctagtctgcaagcctggctagaggatgctgaaaaaatgctcaatcaatcagaaaatgccaaaaaggatttttttcgaaatttacctcattggattcagcagcatactgccatgaacgatgctggcaattttctaattgaaacctgtgatgagatggtttcccgtgacctgaagcagcaattactgttgctaaatgggcggtggagggagttgtttatggaagtcaagcaatatgctcaagctgatgagatggacagaatgaagaaggaatacacagactgtgttgttaccctgtctgcttttgcaacggaagcccataagaaactttctgaacccttagaagtctcttttatgaatgtcaagctattaattcaagacttggaggatattgagcagagggtgcctgtgatggatgcccaatacaagataattacaaagacagcacacctcattaccaaagaaagcccccaagaagaaggaaaagaaatgtttgcgaccatgtcaaagctcaaagagcagctaaccaaggtcaaagaatgttactccccactcctttatgagtctcagcagctgttgattccgttggaggaattagaaaagcagatgacgtccttttatgactcacttgggaaaatcaatgaaattatcacagttcttgagcgtgaggcacaatcgagtgccctttttaaacaaaaacatcaggaactgttagcttgtcaagaaaactgtaagaaaaccttgacacttattgagaaaggcagtcaaagtgttcaaaagtttgtgaccttgagcaacgtgttaaagcattttgatcagacgaggctacaaagacagattgcagatattcatgttgcttttcagagtatggtaaagaaaactggagattggaagaagcatgtggaaaccaacagtcgcttgatgaagaagtttgaggagtctcgagcagagttggagaaggtactgcggattgctcaggagggcctggaggaaaagggggatccagaggagctcctgcggagacacactgagtttttcagtcagctggatcagagggtgctcaatgctttcctgaaagcttgtgatgaactcaccgacatccttccagagcaggagcagcaggggctgcaggaagctgttcgaaagctccacaaacaatggaaggatcttcaaggagaagccccttatcatttgcttcatctgaagattgatgtggagaagaataggttcttagcctctgtagaagaatgcagaactgagctggatcgagagaccaagctgatgccccaggaaggcagtgaaaagataattaaagagcacagggttttcttcagtgacaaaggtcctcatcatctctgtgagaaaaggttacagctcatcgaggaactctgtgtgaaactcccagtgcgggacccagtaagggacacacctggaacctgtcacgtgactctcaaagagctcagagctgccattgacagcacctacaggaagctcatggaagacccagacaagtggaaggactacactagcagattctctgagttctcatcttggatatctacaaatgagacacaattaaaggggatcaagggtgaggccatcgatactgccaaccacggagaggttaaacgtgccgttgaagagatcagaaatggtgttaccaaaaggggtgagaccctcagctggctgaaatccaggctgaaagttttgacagaagtttcttctgagaatgaagcccaaaagcagggagatgagctggcaaaattatccagctctttcaaggctcttgtgacgctgctgtcagaggttgaaaagatgctaagcaattttggggactgtgtccagtacaaagaaatagtcaaaaattctctcgaagaattaatttctggctctaaagaagtccaggaacaagctgagaagatcttggatactgaaaatctgtttgaagcacagcagttacttcttcatcaccagcaaaagacaaagcggatctcagcaaagaagagagatgtgcagcagcagatcgcgcaggcgcagcagggagaaggggggctgcctgaccgaggccacgaggagctgcggaagctggagagcacactggatggcctggagcgcagccgggagaggcaggaacgccgcatccaggtcacattaagaaaatgggagcgatttgaaacaaacaaagaaacagtagtaagatacctttttcaaacaggttccagtcatgaacgcttcttgagttttagcagtttggaaagtttatcttcagaactggaacaaacaaaggagttttctaaacggacagaaagtattgcagtccaggctgagaaccttgtaaaggaagcttcagagataccgcttgggccccaaaataagcagctgcttcaacagcaggccaagtcaatcaaagaacaagtcaaaaaattagaagacacgcttgaagaagatattaaaaccatggaaatggtgaaaaccaagtgggatcattttggcagtaattttgagactctgtccgtctggataactgagaaagaaaaagaactcaatgccttggaaacttcgtcatctgccatggacatgcaaatcagccaaattaaggtcacaattcaggaaatagaaagtaagctcagcagcattgtaggattagaagaagaagcccagtcttttgctcagtttgttaccactggagaatctgctcgaattaaagccaagttgacacaaataagaagatacggggaagagcttcgagagcatgcacagtgtctggaaggaacaatcctgggacatttatctcagcagcaaaagtttgaagagaaccttagaaagatccagcaatctgtgtctgaatttgaagataaacttgctgttccaattaaaatatgttcttcagctacagaaacatacaaagttcttcaagaacatatggatctctgccaggccctggagtcactgagcagcgcgatcactgccttctcagccagtgccaggaaggttgtgaacagagattcctgtgttcaggaggctgcggctctacagcagcaatacgaggacatcctaaggagggcgaaggagagacagacggcgctggagaatctgctggcccactggcagaggctagagaaagaactatcatcctttttgacctggttagagcggggtgaagctaaagccagttccccagaaatggacatttctgcagacagagtcaaagtggaaggtgaacttcagttaatacaggcaagttcaaggaagtttgtatcccaggcctcattctatagcaaacttttgcaattgaaggaatcattgttctcagtagcctccaaagatgatgtgaaaatgatgaaactacatttggagcagttggatgagagatggagagatttaccacagatcattaacaaaaggattaattttcttcagtctgtggttgctgaacaccagcaatttgatgagctgctgctttccttttctgtctggattaaactgtttctcagtgaattacaaactacctctgagattagcataatggaccatcaagtagcccttactcggcataaggaccacgcagcagaagtagagagcaaaaagggcgaattgcagagtctgcagggtcacttagcaaagttgggttctctgggccgtgctgaggacctccacctcctgcagggaaaggctgaggactgcttccagctgtttgaggaggccagccaggttgtggagaggcggcagcttgccctgtcccatttggcagaattcctccagagccatgcctctctgtccggcattctccgccagctgaggcaaacagtggaagcaaccaacagtatgaataagaacgagtctgatttgatagaaaaggacctcaatgatgctcttcaaaatgctaaagcattagaatctgctgccgtcagtctggatggcattctttccaaagcccaataccatctgaaaatcgggagctctgagcaaaggacttcctgcagagccacggctgatcagctctgtggagaggtagagaggatccagaaccttctgggaaccaagcagagtgaggcagatgctctggcagtgttgaaaaaagcattccaagaccagaaagaggagcttctgaaaagcattgaggacattgaagaaaggactgacaaagagcgattgaaagaacctacccgccaagctcttcagcagaggttaagagtgtttaatcagctagaagatgaattgaattctcacgagcatgaactatgttggttgaaagacaaagccaagcaaattgcccagaaagatgtagcttttgcacctgaagttgacagggagataaaccgcttagaggtcacctgggatgataccaaaagactaattcatgaaaatcagggtcagtgctgtggacttattgacttaatgagagaatatcagaacctgaaatcagctgtatctaaagtcttagaaaatgccagcagtgtgattgtaaccagaactaccataaaagatcaggaggatcttaaatgggctttttccaagcatgaaactgccaagaacaaaatgaattacaaacagaaagacttggataactttaccagcaaaggaaaacacttgttatctgagctgaagaaaattcacagtagtgatttcagcttggtgaaaacagacatggagagcaccgtggacaaatggctggatgtatcagagaaacttgaagaaaacatggataggctgagagtaagcctgtccatttgggatgatgtactgtcaactagagatgagattgagggatggtcaaacaactgcgttccacagatggcagaaaacatcagcaacctggataaccacctcagagctgaagaactgcttaaagaatttgagtctgaagttaaaaacaaagcattgagattggaagaactgcattccaaagttaatgatctgaaagaattaactaaaaatctagaaacaccgccagaccttcagtttatagaagcagacttaatgcagaaactggagcatgccaaagaaataactgaagtagcaaaaggaaccctgaaggatttcacggctcaaagtacacaagtggagaagtttattaatgacataacaacatggttcacaaaagtggaagaatcgttgatgaactgtgcccaaaatgagacttgtgaagcattgaaaaaagtcaaggatatacaaaaagaacttcaaagtcaacaaagcaacatcagctctacccaagaaaatctcaatagcttgtgccgcaagtaccactcagctgagttggagagcctgggccgtgcaatgactggtctgataaagaaacatgaagccgtgagccagttgtgctccaaaacccaggccagcctgcaggaatctctggaaaaacacttcagtgagtctatgcaggaattccaagaatggtttttgggagcaaaggcagcagcaaaagaatcatcagatcgcaccggtgacagcaaagttctagaagcaaagctccatgatcttcagaacattttggactcagtcagtgatgggcagagcaaacttgatgcagtgactcaagaaggacaaactttgtatgcacatttgtctaaacaaattgtcagtagcattcaagaacaaatcacaaaggccaatgaagagtttcaagcatttctgaaacaatgccttaaagataagcaggctcttcaagactgtgcttcagaacttggaagctttgaagatcagcacagaaaactgaacttatggatccatgaaatggaagaaaggttcaatacggaaaacttgggagagagtaaacagcacattcctgagaagaaaaatgaagttcataaagttgaaatgtttttgggagaactgctggctgcaagagagtctcttgataagctttcccagagagggcagcttctgagtgaagaaggccacggtgctgggcaggagggccgcctgtgttcccagctcctcacaagccaccagaacctacttagaatgaccaaagagaaactccggagctgccaggtggcccttcaggagcacgaagccctggaggaagcactgcaaagcatgtggttctgggtgaaggccattcaggacagactggcctgtgcagagagcactcttgggagcaaagacaccctggagaaacggctgtcacaaatacaggatattctcctgatgaaaggtgaaggggaagttaagttgaatatggccattggcaagggggaacaggccttgagaagtagcaacaaagaaggtcagagggtgattcagactcagttagagacccttaaagaagtgtgggctgacatcatgagctcctccgtccacgctcaaagcactttagagtctgtgattagccaatggaatgactatgtagagaggaaaaaccagttggagcagtggatggaatcagtggatcaaaaaatagaacatcccttacaaccacagccaggtctgaaagagaagttcgtcctgcttgaccacctccagtccatcctgtctgaggcagaagatcacacgagagcccttcaccgtctaattgcgaagtccagggagctctacgaaaagacagaggatgagtctttcaaggacacagctcaagaggagctgaaaacacagtttaatgatataatgactgttgccaaggaaaaaatgaggaaagtggaagagattgtgaaagatcatctaatgtatttagatgcggtccacgagttcacagattggctccattcagcaaaggaagaacttcaccggtggtcagatatgtctggagattcatcagccacccagaaaaagttatcaaaaattaaggagctgatagattccagagagattggtgcaagccgtctcagcagagtggagtcgctggctcccgaagtgaaacagaacacaactgccagtgggtgtgagctcatgcacacggagatgcaggccctgcgtgccgactggaagcagtgggaagacagtgtattccaaacgcagagctgtttggagaacctggtcagccagatggccctttcggagcaggaattctcaggccaagtggctcaactggagcaggccctggaacagttcagtgcccttctgaaaacctgggctcagcagttaaccctcctggaaggcaagaacacggatgaggagatagtggaatgctggcacaaaggacaagagatactggatgctttgcaaaaagcagagcctagaacagaggatctcaagtctcagctgaatgaactttgtcgattttccagagacctgagtacctacagtggaaaagtttctggcttgattaaagagtataattgtctttgtttgcaagcatccaagggctgccagaataaagaacagattttacagcaaagatttcgaaaggccttcagggatttccagcagtggttggttaatgcaaaaatcactaccgccaagtgttttgatatacctcaaaatataagtgaagtttcaactagtcttcagaaaatacaggagtttttgtcagaaagtgaaaatggacagcacaagctaaacatgatgctgtctaaaggggaacttctgagtaccctgctgaccaaagagaaagcgaaagggatccaggccaaagttacagctgcaaaagaagattggaaaaattttcattcaaatctccaccaaaaagaatctgctctagagaatctaaagatccaaatgaaggactttgaagtaagtgctgagcctatccaggactggctgagtaaaactgagaagatggtccatgaaagcagcaatcgcctctatgatctgccagcaaagaggagggagcagcagaagctccagtctgtccttgaggaaatacactgctacgagcctcagctcaacaggctgaaagagaaagctcagcagctgtgggaaggacaagctgccagcaagagctttaggcacagagtgtcgcagctgtcttctcagtatctagcgctaagcaatttaacaaaggagaaagtgtcaagactggatagaatcgttgcagaacacaatcagttctctcttgggattaaagaattacaagactggatgacggatgcgattcacatgctggattcatactgccacccgacatccgacaaaagtgtgctggacagcaggacgctcaagctcgaggctctattatcagtcaaacaggaaaaagagattcagatgaaaatgatagtgaccaggggagaatctgtccttcagaatacttctccagaaggcattcccactattcagcagcagctgcagagtgtgaaggatatgtgggcatcccttttgtctgcagggattcgttgtaaaagccaactcgaaggagctctctccaagtggacaagttatcaggatggcgttcgacagttctccggttggatggatagtatggaagccaacctgaatgaatcagaaaggcagcatgcggagctgcgggataaaacaacgatgctcggaaaagccaagttattaaatgaagaagtgctgagttacagcagcttgctggagaccatcgaagtcaaaggggctggcatgacagaacactatgtcacccagctagaactccaggatctacaggaacgatacagagccatccaagagagggccaaggaagccgtaaccaagtctgaaaaacttgtccgcctgcaccaagagtatcagagagacctaaaggcatttgaagtttggttggggcaagaacaagaaaagctcgaccagtattcagttcttgaaggtgatgcccacactcatgagacaacattgcgtgatcttcaggagctacaggtacactgtgcagaggggcaggccctgttgaactcagtgctgcacaccagagaggatgtgatcccatcaggtatcccacaggcagaggaccgggctttagagtctctccggcaagactggcaggcttaccagcacaggctgtccgagactcgaactcagttcaataacgtggtgaacaaattgaggctaatggagcaaaagtttcagcaagtagatgaatggctcaaaacagcagaggagaaaaagtggcacgaagaagtgactgcatacagagatgaagttgaggaagtgggagctagagctcaggagatactggacgagagccacgtgaacagcagaatgggttgccaggccacccagctgacttccagataccaggccctgcttctccaagtgctggaacaaataaaattcctggaggaggagattcagagtttggaggaatcagaatcatccctcagttcctattctgattggtatggctctactcataaaaacttcaagaatgtggctaccaagattgacaaagtagatacagtaatgatggggaagaaattgaagacgttggaggttttgctcaaagacatggagaaaggtcacagtttgctgaaatcagcccgggagaaaggagagagggctgttaaatacttggaggaaggcgaggcagagaggttaagaaaggagattcatgatcacatggagcagttgaaggaactgaccagcactgtccggaaagaacacatgacgctggaaaaaggtcttcatttagcaaaggaattctcagataaatgcaaagcactgacacagtggatagcagaataccaggaaattctacatgttcctgaagaacccaaaatggaattatatgagaaaaaagctcagttatctaaatacaagtcacttcaacaaacggtgctgtcccatgaaccatcagtaaagtcagtgagagagaagggtgaagctcttttggaactggtgcaggacgtcactttaaaggacaaaatagatcaacttcaaagtgattaccaggacctgtgcagcataggaaaggcaatgatggaagaaattgctggttttgaagaccgtttgaacaatcttcaaatgaaaggtgatactttgattggccaatgtgcagaccacctgcaagcgaaacttaaacaaaacgtgcatgctcatctgcagggcacaaaggacagctactcagcgatctgcagcacagctcagaggatgtaccagagtttggaacacgaacttcagaagcacgtcagccgacaagacaccctgcagcagtgccaggcctggctttctgcagtccagccggatttagagccaagtcctcaaccacctcttagtagggcagaagccattaagcaggtcaaacacttcagagctttgcaagagcaggcaaggacctacctagatctcctttgctccatgtgtgacctgtcaaatgcttcggtgaaaaccacagcaaaagacattcaacaaacagagcaaacgattgaacaaaagcttgtccaggcccagaacttaactcagggctgggaagagatcaagcacctgaagtctgagctctggatttacctgcaagatgctgatcagcaactgcagaacatgaagaggaggcactctgagctggagctgaacattgcacagaacatggtttcacaagttaaggattttgttaagaaactacagagcaaacaggcatccgtgaacaccataatagaaaaggtgaataagttaacaaagaaggaggaatcgcctgaacacaaggaaataaatcatttaaatgatcagtggctcgatttgtgccgtcagtctaacaacctgtgcttgcaaagggaagaggatcttcagagaacaagagattaccatgactgtatgaatgttgttgaagtgttcctagaaaaatttactacagaatgggataacttggccagatctgatgcagagagtacagctgtccacctggaagctttgaaaaagttagcattggcattgcaggagagaaagtatgctattgaagatctgaaagatcaaaagcagaaaatgatagagcatctgaatttagatgacaaggagttagtcaaagaacagacgagtcatttagagcaacgttggtttcagcttgaggacctcattaaaaggaaaatccaagtgtcagtcaccaacttggaggagttaaatgtggtgcagtccagatttcaggagctaatggagtgggcagaagagcaacaacccaacatcgccgaggcccttaagcagagccctcctccagatatggctcagaaccttctcatggatcacctggccatctgcagtgaactggaggccaagcagatgctcctgaaatcgcttataaaggacgcagacagggtcatggcagatcttggtctcaatgagcgacaggtcatccagaaggctctctctgatgcacaaagccacgtgaattgtctcagtgacttagtgggccagcgaagaaagtacttaaacaaagccttgtccgagaaaacccagtttctcatggcagtgttccaggccaccagccaaattcagcaacatgagcgaaagataatgttccgtgaacacatctgtctgttaccagatgatgtgagcaaacaagtcaaaacatgtaagagtgcacaagccagcctcaagacttaccaaaatgaagtcactggactttgggcccagggtcgcgaactaatgaaggaagtcacagagcaggaaaagagtgaagtgctggggaagcttcaggaattgcagagtgtctatgacagtgttttacaaaagtgcagtcaccggttacaagaactagagaagaatttggtttctaggaagcattttaaggaagattttgataaagcttgccactggctaaaacaagcagatattgttacatttcctgaaatcaacctaatgaatgagagttctgagcttcatacacaactggctaaataccaaaacattcttgaacaatctccagaatatgaaaatcttctacttacgctgcagagaactgggcagaccatattaccatcgctgaatgaagtcgatcattcctacctcagtgaaaagctaaatgctttgcctcgacaatttaatgtaattgttgccttggctaaagacaagttctataaagtccaggaagcaattcttgctcggaaggaatatgcttccttgattgagttgacaacccagtctctgagtgaacttgaagcccaattcttgaggatgagcaaagttcccaccgacctggccgttgaggaggctctttctctgcaagatggttgcagagccattctggacgaggtggcgggccttggggaggcggtggatgaactgaaccagaaaaaagaaggttttcgcagcacaggtcagccttggcagccagacaagatgctgcaccttgtcaccttatatcacaggctgaagcgacaaacagaacagagggttagcttattagaagacaccaccagtgcttaccaagaacacgagaagatgtgccaacagctggagagacaactgaagtctgtaaaagaggagcagtccaaagtgaatgaggaaacgctgcctgcagaggagaagctcaaaatgtatcactccctggcaggaagtctccaggactcagggattgtactgaaacgagtaaccatacatcttgaagatcttgccccacaccttgaccccttggcttatgagaaagccaggcatcagatccagtcctggcaaggggagttaaaactgttgacttctgccattggtgagacggtgacagaatgtgagagccgaatggtgcagagtatagacttccagactgagatgagtcgctccctggactggctgaggagagtgaaggcagagctcagtgggccggtgtacctagacctcaacctgcaggacatccaagaggaaatcagaaaaatccaaattcatcaggaagaggtccagtccagcttgagaatcatgaatgcgctgagtcacaaggaaaaggagaagttcacaaaggccaaggagctgatttctgcggatttagaacacagcctcgctgagctctcagagctggatggagacatccaggaagccttacgcaccagacaggctaccttgactgaaatatatagccagtgtcaaaggtattatcaggtatttcaagcagccaatgactggcttgaggatgcccaagaattgttacagctggcaggcaatggcctagacgtggagagcgcagaggaaaatctcaaaagccacatggaatttttcagtacagaggatcagttccatagtaacctggaggagctccacagcctggtagccaccctggacccactcatcaagccaaccggcaaagaagacctagaacagaaagtggcttctctggaactcaggagccagaggatgagccgggactctggtgcccaagtggatctcttgcagagatgcacagctcaatggcacgattaccagaaagcaagggaagaggttattgaattgatgaatgatacagaaaagaaattgtctgagttttctttgttgaagacttcgtctagtcatgaagcggaagaaaaattgtcagaacacaaggctttagtgtcagtggttaactctttccatgagaaaattgtggcccttgaggaaaaagcttcacaactggagaaaaccggaaatgatgccagcaaagccaccctgagcaggtcaatgaccaccgtctggcagcgctggacacgccttcgagctgtggcccaggaccaggagaagatcctggaagatgcagtggatgagtggacgggctttaacaacaaggttaaaaaggccactgaaatgattgatcagctgcaagataagttacctggaagttcagcagagaaagcatcgaaagcagagctcttaactcttcttgaataccacgacacgttcgttctggagctggagcagcagcagtcggccttgggcatgctgcggcagcaaaccctgagcatgctccaggatggagccgccccaacccctggggaagagcctccgctcatgcaggaaatcaccgccatgcaagatcggtgcctgaacatgcaggagaaagtgaagactaatggaaagttggtgaagcaagagctgaaggaccgagaaatggtggagactcagatcaattctgtgaaatgttgggttcaggaaacgaaagaatatttagggaatccaacaatagaaatagatgctcaacttgaagaacttcagattctcctaacagaagccacaaatcaccgacagaacattgaaaaaatggcagaagaacagaaggagaagtacttaggtctttataccatattaccttctgaactctcccttcagttggctgaagtggcgttagatctaaagatccgagatcagatccaagacaaaataaaagaagttgagcagagcaaggccacgagccaggaactcagccggcaaattcagaagttagctaaagacctcacaactattctaactaagctgaaagcgaagacagataatgtagttcaagctaaaactgaccaaaaggtgctgggagaggaattagatggctgtaattcaaagttaatggaattagatgcagcagtacagaaattcttggaacagaatggccaactgggtaagccactggccaagaagataggaaaactgactgaacttcaccagcagaccattagacaagctgagaatcggctctccaagctcaatcaggcagcatcacatttagaagaatacaatgaaatgcttgaattaattttgaagtggattgaaaaagctaaagtcttggctcatggaactattgcatggaattctgcaagccagcttcgggaacaatatattttgcatcagaccctgctagaagaatccaaagaaattgacagtgagctggaagcaatgactgagaaattacagtacctcactagcgtgtactgtacagaaaaaatgtctcagcaagtggcagaactgggacgggagactgaggagttgcgacagatgatcaaaattcgtttgcagaacctccaagatgcagctaaggatatgaaaaaatttgaagcagagttgaaaaagttacaagctgccttggagcaagcccaggcaacactgacttctccagaagttggacgtctcagtctcaaggagcagctctctcatcggcagcatttgttgtctgagatggagtcactgaagccgaaggtgcaagcagtgcagctctgccagagtgccctccggatccccgaggatgtggttgccagcttacctctctgtcatgctgctctgcggctgcaggaagaggccagccggctgcagcacaccgccatccagcagtgtaacatcatgcaggcagctgtggtacaatatgaacaatatgagcaagaaatgaaacatctccagcaactgatagaaggagctcacagagagattgaggataaacctgttgccaccagtaacatacaggagctgcaggctcagatttctcggcatgaggagctggcgcagaaaattaagggctaccaggagcagatcgcttctttgaattccaagtgcaagatgctgacgatgaaagccaagcacgccaccatgctgctgacggtgaccgaggtcgaggggctggcggaagggacagaggacctggatggggagctcctccccacgccttcggcccacccctctgtggtcatgatgactgcaggtcgctgtcacactttgctgtcaccggtcactgaggagtctggggaggagggaaccaacagtgagatttcctctccacctgcctgtcgctccccttcacctgtggctaatacagatgcttctgttaaccaggacattgcatattaccaagccttgtctgctgagaggttgcagacagatgctgcaaaaattcaccccagcacatccgcatcccaggagttctatgaaccgggattggagccatccgctactgccaaactgggtgatttgcagcgttcttgggaaaccttaaagaatgtgatcagtgagaagcagcgcacactctatgaagctttggaacgccagcagaagtaccaggactccctccagtccatctctacgaagatggaggccattgagctgaaactcagtgagagcccagagcctggcaggagtccagaaagccagatggctgaacatcaggcattgatggatgagattctcatgctccaggatgaaatcaatgagctccagtcctctctcgcagaggagctggtatccgagtcttgtgaggccgaccctgcggagcagctggccttgcagtccacgctcactgtcttagccgagcgaatgtccaccatcaggatgaaagcctcggggaaacggcagcttttggaggagaagttgaatgatcagctggaggaacaaaggcaggaacaggccctgcagaggtatcgctgtgaagccgatgagctggacagctggctcttgagtaccaaggccactctggacactgcgctgagtccacccaaggagcccatggacatggaggcccagcttatggactgccagaatatgctggtggaaatagagcagaaggtggtggctttatcagaactgtcagtccacaatgagaacctgctgctggagggcaaagctcacaccaaggacgaggccgagcagctggctggaaagctgagaaggctcaaggggagcctgctggagctgcagagagccctgcatgataagcagctcaacatgcagggaacagcacaggagaaggaggagagcgatgttgacctaacagccacgcagagccccggcgtccaggaatggctggcccaagctcgcaccacatggacccagcagcggcagagcagtctccagcaacaaaaagagttagaacaggaattagccgagcagaagagtctccttcgctcagtagccagtcgtggagaggagattctaattcaacattcggcggcagagacctctggtgatgctggcgaaaaacctgatgtgttatcccaggagttggggatggaaggggagaaatcatccgctgaagaccagatgagaatgaaatgggaaagcctacatcaagaatttagtaccaagcagaaactactacagaatgttctggaacaggaacaagagcaagtgctttatagcaggccaaatcgactcttgtctggtgtgccactgtacaaaggggacgtgccaacccaagataaatctgcagttacatctttgctggatggactgaaccaagccttcgaggaggtttcatcccagagtggaggggcaaagaggcagagtatacacttggagcagaagttgtatgatggagtctcagccacctctacttggttggatgacgttgaagaacgtttatttgttgccacagcacttttaccagaagaaacagagacttgtctcttcaaccaagagattcttgccaaagacattaaggaaatgtctgaagaaatggataagaacaaaaacttgttttcccaagcttttccagagaatggtgataatcgagatgttattgaagatactttgggttgtcttttgggcaggttatccttgctagactcagtagtgaatcaacgatgtcatcagatgaaagaaagacttcagcaaatactaaatttccagaatgatctgaaagtgctgtttacatcactggctgacaacaaatacatcattctgcaaaaactggcaaatgtgtttgaacagcccgtagcagaacaaatagaggcaatacaacaggctgaagatggactcaaagaatttgatgcaggaatcattgaattaaagaggcgtggtgacaagctacaggtcgagcagccgtccatgcaagaactctccaagctccaggacatgtatgatgagctgatgatgatcattggctcccggaggagtggtctgaatcagaaccttacactcaagagtcagtatgagagggccctacaagatctggctgacctgctagaaactggtcaggagaagatggcaggagaccagaaaatcatcgtgtcttccaaagaggaaatccagcaactacttgacaaacataaggaatactttcagggcctggaatctcatatgatcttgactgaaacactcttcagaaagataatcagctttgcagtccaaaaggaaacccagttccatacagagctgatggctcaggcttctgctgtactgaaacgggctcacaagaggggtgtggagctggagtacattctagagacgtggtcccatctggatgaggaccagcaggagctcagcagacagctggaggtggtggaaagcagcatcccaagcgtgggtctggtggaggagaacgaggacaggcttattgaccgcataacactctaccagcatttaaaatctagccttaatgaataccagcccaaattatatcaagtattagatgatgggaaacgacttctgatatccatcagctgctcagatctagaaagccaactaaatcaacttggagagtgctggctaagtaacaccaataaaatgtctaaggaacttcacagactggaaacaatattgaaacactggaccagatatcaaagtgaatctgcagatctaattcactggttacaatctgcaaaagaccggctagaattttggactcagcaatctgtgacagtcccacaagagctggaaatggtccgtgatcatctaaatgctttcctggagttttctaaagaagtggatgcccaatcttccctgaaatcatctgttctgagtactggaaatcagctccttcgactaaaaaaggtggacacagccacgctgcgctctgagctgtcgcgcattgatagccagtggactgacctgctaaccaatatcccagccgtccaggagaagctccaccagctccagatggataaactgccttcccgccatgccatttctgaagtcatgagttggatttctctaatggaaaatgttattcagaaggatgaagataatattaaaaattccataggttacaaggcaattcatgaataccttcagaaatataagggttttaagatagacattaactgtaaacagctgacagtggattttgtgaaccagtccgtgctacaaatcagcagtcaggatgtggaaagtaagcgtagtgataagactgattttgctgagcaacttggagcaatgaataaaagttggcaaattctgcaaggtctagtaactgagaagatccagctgttggaaggcttattggaatcttggtcagaatatgaaaataatgtacaatgtctgaaaacatggtttgaaacccaggaaaagagactaaaacaacagcatcgaattggagatcaggcttctgttcaaaatgcactgaaagactgtcaggatctggaagatttgattaaagcaaaagaaaaagaagtagagaaaattgagcagaatggacttgctttgattcagaacaagaaagaagacgtctctagcattgtcatgagcacactgcgagagctcggccaaacctgggcaaatttagatcacatggttggacaattaaagatactgctgaaatcagtgcttgaccaatggagtagtcacaaagtggcctttgacaagataaacagttacctcatggaggccagatactctctttcccgattccgtctgctgactggctccttagaagctgtgcaagttcaggtggacaatcttcagaatctccaagatgatctggaaaaacaggaaaggagcttacagaaatttggctctatcaccaaccaattattaaaagagtgtcacccacccgtgacagaaactcttaccaatacactgaaagaagtcaacatgagatggaataacttgctggaagagattgctgagcagctacagtccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgacctcctcaaaggactgggcacagttaaagattccctcttttttctccatgagctgggagagcaactgaagcaacaagtggatgcttccgcagcatcagctattcaatcggatcaactctctttgagtcaacacttgtgtgccctggagcaagctctctgcaaacagcagacttcattacaggctggagttcttgattatgaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaaatgagcttggatataggttacccttgaatgataaggaaatcaaaagaatgcagaatctgaaccgccattggtctctgatctcctctcagactacagaaagattcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgagttgtttcaagccgagatgttcagtcgtcagcagattttgcactcaatcattattgatgggcaacgtcttctagaacaaggtcaagttgatgacagggatgaattcaacctgaaattgacactcctcagtaatcaatggcagggagtgattcgcagggcccagcagaggcgggggatcattgacagccagattcgccagtggcagcgctatagggagatggcagaaaagcttcgtaaatggttggttgaagtgtcctacctccccatgagtggtctcggaagtgttcctataccactgcaacaagcaaggaccctctttgatgaagtgcagttcaaagaaaaagtgtttctgcggcaacaaggcagctacatcctgactgtggaggctggcaagcaactccttctctcggcggacagtggcgctgaggccgccttgcaggccgaactcgctgaaatccaagagaaatggaaatcagccagcatgcggctggaagaacagaagaaaaaactagccttcttgttgaaagactgggaaaaatgtgagaaaggaatagcagattccctggagaaactacgaactttcaaaaagaagctttcgcagtctctcccggatcaccatgaagagctccatgcagaacaaatgcgttgcaaggaattagaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagcagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttggcttatcagatgtaatgatccccgaaagccctgaggcctatgtaaaactcacagaaaatgcaatcaaaaatacctccggggaccacagtgccctagagtcacagatccgacaactgggcaaagccctggatgatagccgttttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacgccacgaggcaagtgtagtctctcacagcctggaccctctgtcagcagtccacatagcaggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaaagatatttatgtatgtacagtttgctaaagccaagttttgtttgtattgatttctttgcatttattatagatattataaaata

SEQ ID NO: 29629 - DNA, 3768 bp, Homo sapiens
cttgtcactgcccagtgtcatgttatcgggcagagactaccaacatttgtctacagtgagcattttcatacttctatacacagacaaggggaaactttcatccccacgcaggatatagctttttgctctgcagagtctaacttttgcaagtggaagcttcatggtggtggcggaggacctgagtgccctgaggatggcagaggacagctgtgtggatgcagatctcccagattgtaactgcgatgtcacaagggtgaagaagctgaaggagaccctggtagccgtgcagcagcttgataagaacatgagcagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttggcttatcaggggaccacagtgccctagagtcacagatccgacaactgggcaaagccctggatgatagccgttttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacgccacgaggcaagtgtagtctctcacagcctggaccctctgtcagcagtccacatagcaggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaaagatatttatgtatgtacagtttgctaaagccaagttttgtttgtattgatttctttgcatttattatagatattataaaata

SEQ ID NO: 29630 - DNA, 20475 bp, Homo sapiens
atggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgaggcctgcttttctgaggaaggctgcctgtaccagcttaatcaccacatggaagtcctgagggagctgtgtgaagagctgccttcacagaagagtcaacaagaagtgaagagactactcaaagattatgaacaaaagatagaaagacttctgaaatgtgcttccgagattcatatgacactgcagcccacagcgggaggcacgtcgaaaaacgaggggaccatcaccacatctgagaatagaggaggggatccccacagtgaggcaccatttgcaaaatcagataatcagccatcaactgaaaaggcaatggaacccactatgaagtttagcctggcatcagtgttaaggcctctgcaagaagaaagcattatggaaaaggattacagtgcatctataaatagtttactagagaggtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaatggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaactaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagcggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacagcattctcaaatcaaaacgctcaacagaaaagaaaggaaagtttactctgccaggcagagagaagcaggccacttctgatgtgcaggagtctactcaggaatcagctgcagtggaaaagttggaggaagactgggaaataaacaagaattttgttgaaaatgtgatggcagtttccaaaaattgccatcatagcatgtatatatttgaatccattgtcaagaatttcatttcagatgaaatgcaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcagtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaagataaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcattcaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatgatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacacatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgatcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcaggtcagcctttttgggggtttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctgaacgcccatgtagccaggtgtggtggcgcatctcttaaaaaacaggaccttcgctactctctgcacactgcctgcggagcggccctgctctgcaggagcagtcacggagctaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaagagaacagttggaagagaggaggttccagagagatgggagtgtgagaccattgtcagtgggcatggtaccgaggagagttgctttctctccattagaaagtttcaccagggaaggggcttacatatccttacatgtcagctgataccccaagactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagtatggcagatcagacaaactccaggtggatgttttttcagtggccacgtggcatacagcgaaccgtcacttggccttgggaccacttgtgcagctgtgcttccactggccacacgggtcctttccatagcagtgtgctcagatgttttgaacaacacatagaatttggaatatacaggagaacctataaggtgaataaagaattgggaggtgataaaaacggacagagatgccccataatctacccgcatgggctggttcaatgtatacggctgggtgaacccctcatactgaagcgggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggagggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatgtaagtcttaacttcactgggagtacagcctatgtctgtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagtttctttacccagcagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctga

SEQ ID NO: 29631 - DNA, 21777 bp, Homo sapiens
gccaaggagcggagcgcgctcagctgcgcccagagccttcggccggacctgaaaaagcgagagggagagcgagcaaaaggcgcgatccagagagccaggcaagcggggcgccgacctcgggcggccccggcccgcgcccttgcccctcggccgggcggacgttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgaggcctgcttttctgaggaaggctgcctgtaccagcttaatcaccacatggaagtcctgagggagctgtgtgaagagctgccttcacagaagagtcaacaagaagtgaagagactactcaaagattatgaacaaaagatagaaagacttctgaaatgtgcttccgagattcatatgacactgcagcccacagcgggaggcacgtcgaaaaacgaggggaccatcaccacatctgagaatagaggaggggatccccacagtgaggcaccatttgcaaaatcagataatcagccatcaactgaaaaggcaatggaacccactatgaagtttagcctggcatcagtgttaaggcctctgcaagaagaaagcattatggaaaaggattacagtgcatctataaatagtttactagagaggtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaatggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaactaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagcggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacagcattctcaaatcaaaacgctcaacagaaaagaaaggaaagtttactctgccaggcagagagaagcaggccacttctgatgtgcaggagtctactcaggaatcagctgcagtggaaaagttggaggaagactgggaaataaacaaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcagtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaagataaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcattcaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatgatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacacatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagcagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccaga

SEQ ID NO: 29632 - DNA, 985 bp, Homo sapiens
agagccttcggccggacctgaaaaagcgagagggagagcgagcaaaaggcgcgatccagagagccaggcaagcggggcgccgacctcgggcggccccggcccgcgcccttgcccctcggccgggcggacgttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagcttacaaaaacttctga

SEQ ID NO: 29633 - DNA, 21878 bp, Homo sapiens
gtttgccgctttccgagcgccaaggagcggagcgcgctcagctgcgcccagagccttcggccggacctgaaaaagcgagagggagagcgagcaaaaggcgcgatccagagagccaggcaagcggggcgccgacctcgggcggccccggcccgcgcccttgcccctcggccgggcggacgttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgaggcctgcttttctgaggaaggctgcctgtaccagcttaatcaccacatggaagtcctgagggagctgtgtgaagagctgccttcacagaagagtcaacaagaagtgaagagactactcaaagattatgaacaaaagatagaaagacttctgaaatgtgcttccgagattcatatgacactgcagcccacagcgggaggcacgtcgaaaaacgaggggaccatcaccacatctgagaatagaggaggggatccccacagtgaggcaccatttgcaaaatcagataatcagccatcaactgaaaaggcaatggaacccactatgaagtttagcctggcatcagtgttaaggcctctgcaagaagaaagcattatggaaaaggattacagtgcatctataaatagtttactagagaggtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaatggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaactaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagcggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacagcattctcaaatcaaaacgctcaacagaaaagaaaggaaagtttactctgccaggcagagagaagcaggccacttctgatgtgcaggagtctactcaggaatcagctgcagtggaaaagttggaggaagactgggaaataaacaaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcagtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaagataaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcattcaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatgatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacacatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcaggattccaagtgttttagaagtggaccaagaccaaatatttatgtttcttattatgttacagttatacagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagcagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccagacttctgttgtactg

SEQ ID NO: 29634 - DNA, 21875 bp, Homo sapiens
gtttgccgctttccgagcgccaaggagcggagcgcgctcagctgcgcccagagccttcggccggacctgaaaaagcgagagggagagcgagcaaaaggcgcgatccagagagccaggcaagcggggcgccgacctcgggcggccccggcccgcgcccttgcccctcggccgggcggacgttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgaggcctgcttttctgaggaaggctgcctgtaccagcttaatcaccacatggaagtcctgagggagctgtgtgaagagctgccttcacagaagagtcaacaagaagtgaagagactactcaaagattatgaacaaaagatagaaagacttctgaaatgtgcttccgagattcatatgacactgcagcccacagcgggaggcacgtcgaaaaacgaggggaccatcaccacatctgagaatagaggaggggatccccacagtgaggcaccatttgcaaaatcagataatcagccatcaactgaaaaggcaatggaacccactatgaagtttagcctggcatcagtgttaaggcctctgcaagaagaaagcattatggaaaaggattacagtgcatctataaatagtttactagagaggtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaatggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaactaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagcggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacagcattctcaaatcaaaacgctcaacagaaaagaaaggaaagtttactctgccaggcagagagaagcaggccacttctgatgtgcaggagtctactcaggaatcagctgcagtggaaaagttggaggaagactgggaaataaacaaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcagtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaagataaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcattcaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatgatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacacatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcagatgtagaaatccctgaaaatcctgaggcatatcttaaaatgaccacaaaaactttgaaagcgtcttctggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccagacttctgttgtactg

SEQ ID NO: 29635 - DNA, 11095 bp, Homo sapiens
tgctgcttgcagctttttagatcaggactgcaatggagatacaattaaatcctaaaggtactttagaagcagggggtgttgtaatgtcttttctagataatggtgtgacactatgaagagatatcaagtttaattcttacaaattagaaagcatcatctgactaaactgagtgtctctggggcttaatcagcttgtatcactagtggggttttgtcatgcaaactgcactcctttaaatcataaggatgtgctggaaggctgctttcactttttagaattaaacttttcccccagtctcgtgagtattgcaactctcttaatgcttttaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcaggattccaagtgttttagaagtggaccaagaccaaatatttatgtttcttattatgttacagttatacagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagcagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagcc

SEQ ID NO: 29636 - DNA, 3084 bp, Homo sapiens
cgtgtctacctctgccttctgtggacaccatgcgccttggtccttgtgtcatggtgtatttacactgccgtactcacccataactgcgtgctccttacaaaaccccatccaagccagagccgtctcgatgccaaccccctctcctcccttcaggcctgtgcagagggaatttttcatggtgcctgttttgatgatttttttctccatctaactgaagtcctttggcatgggccaagctttcttcatggtggcttggtttggaactgtttccttgctttactgggatcccctggtggaaaggggtggggggttggggcggtaaagggtgctgatgatttgccacaggagggaaaaaaccttcctttccttgatttgcagctctaatcctcatccttagccccatccctatctgccatggtgggtcggggagagccctgaggagccttttggttcccaagtccatcttgatgttcactcttcccctcactcctgagaggccttctgccatcttggtccccagacccggccttgccactcagtgtccctaccactcgagaccctggctccaaaacgccactcatcccacagcaaatcatgttggtcgtgctccgttgtgtacccatctagtgaaggcacagtgttgctgagttgcatgactcatctcattctcttctgggacatactgacattttgcaaacatgcatgctttgcaaggaaagctgcagaactcattttcatactgtaacctgatgccatgtcacccgtgacccgttcagtaggagagaatagactgtcgcttgctgtctttcgtttcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccagggctctaagacacggccgcgctctgatgtgttgttttttaaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagcc

SEQ ID NO: 29637 - DNA, 2669 bp, Homo sapiens
gcagaagcctatgagttgattaattctaacaactggatactgtggtttagggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcagatgtagaaatccctgaaaatcctgaggcatatcttaaaatgaccacaaaaactttgaaagcgtcttctggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccagggctctaagacacggccgcgctctgatgtgttgttttttaaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagcagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccag

SEQ ID NO: 29638 - DNA, 3277 bp, Homo sapiens
cagggtctcccccactaaaccgtgcgggtgtcaggggataaaagaagtgcaaaagcacaggcttggaggggatggcttgtgttaagttgctttgctcccatcagaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagcagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagcc

SEQ ID NO: 29639 - DNA, 11532 bp, Homo sapiens
atggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcagatgtagaaatccctgaaaatcctgaggcatatcttaaaatgaccacaaaaactttgaaagcgtcttctggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccag

SEQ ID NO: 29640 - DNA, 3396 bp, Homo sapiens
ggcaaggccttgcaaataacaatttaccctgagtggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagcagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagcc

SEQ ID NO: 29641 - DNA, 8047 bp, Homo sapiens
ggtttttttttttcccccacatacttaacgtttctatatttctatttgaattcgactggacagttccatttgaattatttctctctctctctctctctgacacattttatcttgccaggttctaaacctttaggaaaaatggagcaatttccaaaggaaaccgttgtggagagcagtgggccaaaggttttggaaacagcagaagagatccaggagaggcgtcaggaagtgttgactcggtatcaaagtttcaaggagcgggtcgctgagaggggtcagaagcttgaggattcctatcacttacaagttttcaagcgagatgcagatgatctggggaagtggatcatggagaaagtcaatatcttaaccgataagagctatgaagacccaactaatatacaggggaaatatcagaagcatcaatcccttgaagcagaggtgcaaacaaaatcaagactcatgtctgaactggaaaaaacaagggaagaacgatttaccatgggtcattctgcccacgaagaaacgaaggcccatatagaggagctacgccacctgtgggacctgctgttagagctgaccctggagaagggtgaccagttgctgcgggccctgaagttccagcagtatgtacaggagtgtgctgacatcttagagtggattggagacaaggaggctatagcgacatcagtggagctaggtgaagactgggagcgcaccgaagttctgcataagaaatttgaagacttccaagtggagctggtagctaaagaagggagagttgttgaagtgaaccaatatgccaatgagtgtgccgaggaaaaccatcctgacctacccttaattcagtctaagcaaaatgaggtgaatgctgcctgggagcgccttcgtggtttggctctccagagacagaaagctctgtccaatgctgcaaacttacaacgattcaaaagggatgtgactgaagccatccagtggatcaaggagaaggaacctgtactcacctctgaggactatggcaaagaccttgttgcctctgaaggactgtttcacagtcacaagggacttgagagaaatcttgctgtcatgagtgacaaggtgaaggagttatgtgctaaagcagagaagctgacactttcccatccttcagatgcacctcagatccaggagatgaaagaagatctggtctccagctgggagcatattcgtgccctggccaccagcagatatgaaaaactgcaggctacttattggtaccatcgattttcatctgactttgatgaactctcaggctggatgaacgagaagactgctgcgatcaatgctgatgagctgccaacagatgtggctggtggagaagttctgctggacaggcatcagcagcataagcatgagattgactcttacgatgaccgatttcaatctgctgatgagactggtcaagacctcgtgaatgccaatcatgaagcctctgatgaagttcgggaaaagatggaaatacttgacaacaactggactgccctgctggaactgtgggacgagcgtcatcgtcagtatgagcagtgcttggactttcatctcttctacagagacagtgagcaagtggacagttggatgagtagacaagaggccttcctggaaaacgaggatctgggaaactcactgggcagtgcagaagcccttcttcagaagcatgaagactttgaggaagcctttactgcccaggaagagaagatcataactgtagacaagactgcaaccaaattgattggtgatgaccattatgattcagagaacatcaaggctatccgtgacgggctgttagcccggcgggatgccctacgtgaaaaggctgccactagacgtagattgctgaaggagtcattgcttctgcaaaaactgtatgaggactcagatgacctaaagaactggatcaacaagaagaaaaagttggcagatgatgaagattacaaggacatacagaacttgaagagcagggttcaaaagcagcaagtctttgaaaaggagttggcagttaataagacccagctggaaaacatacagaaaactggccaagagatgattgagggtggtcactatgcctctgacaatgtgaccactcgtctgagtgaagttgccagcctctgggaggagttgctggaggctacaaaacagaaagggacccagttgcatgaggccaaccagcagctgcaatttgaaaataatgcagaagatttgcagcgctggctggaggatgttgagtggcaagtcacctctgaggattatgggaaaggcctggccgaggtacagaatcgactcaggaaacacggcctcctggagtcggctgtggctgctcgtcaggatcaggtggatatccttacagacctggctgcatattttgaagaaataggccatcctgattctaaggatataagggcaaggcaagagtccttggtatgccgatttgaagctctgaaagagccactggccacccgaaagaagaagctcttagaccttctccatctgcagctgatttgtagagacacagaggatgaggaggcctggatccaagagactgaaccctcagctacttccacctaccttggaaaggacctgattgcttccaaaaagcttctgaataggcatagagtcatcctggagaacattgccagccatgaaccacgcattcaagagataacagaaaggggaaacaaaatggtagaggaaggacactttgctgcagaagatgtggcctctagggtcaagagtttgaaccagaatatggagtctctccgtgctcgagctgctaggcgacaaaatgatcttgaagccaatgtccagttccagcagtacctggctgacctgcatgaagcagaaacatggatcagagagaaggaacctattgtagataatactaactatggtgctgatgaagaagcagctggggctcttctaaagaagcatgaggcctttctattagatctcaattcatttggagacagtatgaaagctctgcggaatcaggcaaacgcctgccagcaacaacaggctgcaccagtggagggagttgctggagaacaaagggtcatggctttatatgacttccaggcccgcagcccccgagaagtcaccatgaagaaaggtgatgtcttaacgctgctcagttccatcaataaggactggtggaaggtggaagctgctgatcatcagggcattgtcccagctgtctatgtcagaagactggcccacgatgagttcccgatgctcccacagcggcgacgagaagagccaggaaacatcacccagcgccaggagcagattgagaaccaataccgctccctcttggatcgggcagaagaacgcagacgtcgtctattgcaacgttataatgaatttttattggcctatgaggcaggagacatgctggaatggattcaagagaaaaaggcagaaaacactggagtggaactagatgatgtttgggagctgcagaaaaagtttgatgagttccaaaaggatttgaataccaatgagcctcggctaagggatatcaacaaggtagctgatgatctactatttgaaggacttctaacaccagaaggagctcaaatccggcaggaattgaattcccgctggggttctttgcagaggcttgcagatgaacagcggcagctgctgggcagtgcccatgctgttgaagtgtttcacagagaagcagatgacacgaaggagcagattgagaagaaatgccaggccctcagtgctgcagaccctggctcagatctgttcagtgttcaggctcttcagcgacggcatgagggctttgaaagggacctcgtacccctgggagataaggtgaccatactgggggagacagcagagcggctcagtgagtcccatccagatgccactgaggacctgcagagacagaaaatggagctgaatgaggcctgggaagacctgcaggggcgtacaaaggatcgtaaggagagcctaaatgaggcccagaaattctacctgttcctcagcaaggccagggatctgcagaactggatcagtagcattggtggcatggtatcatcacaggagctggccgaagacttaactggcatagagatcttgctggagagacatcaggagcaccgtgctgacatggaggcagaggctcccaccttccaggccttagaggacttcagtgcagaacttatcgacagtgggcaccatgctagccctgaaattgaaaaaaagcttcaagctgtcaagctagagagagatgatttggagaaggcttgggaaaaacgcaagaagatcctagaccagtgcctggagttgcagatgttccaggggaactgtgatcaagttgagagctggatggtggcacgtgagaattccctgaggtcagatgacaaaagttccttagacagtctggaggctttgatgaagaaacgggacgatttggacaaagcaatcactgcccaggaagggaagatcactgacctagaacattttgctgagagcctcattgctgatgaacactatgccaaagaagagattgctacgcggctccaacgtgtactagacaggtggaaggctctcaaagcacaactgattgatgagcggacaaagcttggagactatgccaacctaaaacaattctaccgagaccttgaggagctggaagaatggatcagtgagatgctgcccacagcctgtgatgaatcctacaaagacgccactaacattcagaggaaatacctgaaacaccagacctttgcacatgaagtcgatggccgatctgagcaggtgcatggcgtcatcaacctggggaactccctgattgagtgtagcgcttgtgatggcaatgaagaggccatgaaggagcaactggaacagctgaaggaacattgggatcatctgcttgagagaacaaatgacaaagggaagaagctcaatgaggccagtcgtcaacagaggttcaacacaagcatccgggactttgagttctggctctcagaggcagagacattgctggccatgaaagatcaggccagggacttggcttcagcaggaaacctactcaagaagcatcagctattggagagagagatgttggctcgagaggatgcactcaaggacctgaatacattggctgaagatttgctctccagcgggactttcaacgttgatcagattgtgaagaaaaaagataatgtcaacaagcgtttcctgaatgtccaagaattggcagctgcacaccacgaaaaattgaaagaggcctatgccttgttccagttcttccaggatctagatgatgaggaatcctggatagaggagaagttgatacgagtgagctcccaggactatgggagagatcttcagggggttcagaacttgctgaagaagcacaaacgcctagagggggagctggtggcccatgagcctgccatccagaatgtgctggatatggcagagaagctgaaagacaaggctgctgtggggcaagaggagatccagttgcggctggctcagtttgttgaacactgggagaagctcaaagagttggccaaggcccgaggacttaagttggaagaatccctagaatacttgcaattcatgcagaatgctgaggaagaggaagcttggatcaatgaaaagaatgctttggctgtccgaggagattgtggagatacattagctgctactcagagcttgctaatgaagcatgaagctttggaaaatgactttgctgtccatgagacccgagtacaaaatgtgtgtgcacaaggagaagacatcctaaataaggaggaaagtcagaacaaagagatttcttccaagatagaggctctgaatgaaaagaccccttctctggctaaggcaatagctgcttggaagttgcaattggaagacgattatgcctttcaggaattcaactggaaggctgatgtggtagaggcttggatagctgataaggaaacaagcctaaagaccaatggcaatggtgcagaccttggtgacttcctcactcttctggcaaaacaggacactctggatgccagtctgcagagtttccagcaagagagacttcccgagatcactgacctgaaggacaaactgatttctgctcaacacaaccagtctaaagccattgaagagcgttatgccgctctgctgaagcgctgggaacagttgctggaagcctcggcagtccacagacagaaattgctggagaaacagctgcctctacagaaggctgaggacctgttcgtggaatttgcacataaggcttcagctttgaacaactggtgtgaaaagatggaagaaaacttgtcagagcctgtgcactgtgtctccctgaatgaaattcggcagctgcagaaagaccatgaggacttcttggcctccctggctagggctcaagcagactttaaatgtttgctggagctagaccagcagattaaggccttaggtgtgccttccagcccttatacctggttaacagtggaggtgctggaaaggacctggaagcacctatctgacatcattgaggaacgggagcaggagctgcaaaaggaagaggcaagacaggtcaagaactttgagatgtgtcaggagtttgaacagaatgccagtaccttccttcaatggatcctggaaaccagggcttactttctggatggatcattgctcaaagaaacaggaactctggaatctcagctggaagcaaataaaagaaaacagaaggagatccaggcgatgaagcgtcaactaaccaagattgtggacctgggggacaacttggaagacgctctgatccttgatatcaaatacagcaccattggattggctcagcagtgggaccagctctaccagcttgggttgcggatgcaacacaacctggagcaacagatccaggccaaggacatcaaaggtgtgagtgaagagactctaaaggaatttagcacaatctataaacactttgatgagaatttgacagggcgcctgactcacaaagagttccggtcctgcctgagaggactcaattactacttgcccatggtggaggaggatgaacatgagcccaagtttgagaagttcctggatgctgtggatccagggaggaagggctatgtctcactggaggactatactgctttcctgattgacaaggagtcagaaaacatcaagtccagtgatgaaatagagaatgccttccaagccctggcagagggcaagtcatatattaccaaagaagacatgaagcaggcccttaccccagagcaagtgtcattctgtgccacacatatgcagcaatatatggacccacggggtcgaagccatctctctggctatgactacgttggcttcaccaattcctactttggcaactaataagcagctcctcgtggatcgtagaaaatcttagtgtcgtgggaaatttactggggggcaaagagtacaggcaaatgtggaagataaagatggcctcgtgtgtgtgtgtgtgtgtgtgtgtgtgtgtgtgtgcttgtgtttgtgtgcatattacatttattgtaggatcttaaaaaatctcaagggtgggagatagaaaggttaatagagttggaggagtggaagctattttgtatgcaactagtcactgctgaggggtgtcaaagtttctatttttatttgttctgttttgcacgtctttatcattttgctttattccgattatagaataaagtaattctttttaaaaatattttttggggcaaagttaagtaaaatgttgagcttctatatttctgggaactgtactcatataagagtgggcagctaattttactgtaaagaagggccatggtatagtagataaataaaatccaaggcaattttcaaacaatttttttaaactttggaatgtgtttaaatttaaatttgaaaataaagatatttgattttctggggaacatgaatattttagtttgtacaatgaaacaacacacagatcagcataacacctgttttcttcttgttttttttccatacttcaaaattattgtagatg

SEQ ID NO: 29642 - DNA, 8217 bp, Homo sapiens
tgtcgattgtgtatggctgatgggattctaggaccaagcaagaggtttttttttttcccccacatacttaacgtttctatatttctatttgaattcgactggacagttccatttgaattatttctctctctctctctctctgacacattttatcttgccaggttctaaacctttaggaaaaatggagcaatttccaaaggaaaccgttgtggagagcagtgggccaaaggttttggaaacagcagaagagatccaggagaggcgtcaggaagtgttgactcggtatcaaagtttcaaggagcgggtcgctgagaggggtcagaagcttgaggattcctatcacttacaagttttcaagcgagatgcagatgatctggggaagtggatcatggagaaagtcaatatcttaaccgataagagctatgaagacccaactaatatacaggggaaatatcagaagcatcaatcccttgaagcagaggtgcaaacaaaatcaagactcatgtctgaactggaaaaaacaagggaagaacgatttaccatgggtcattctgcccacgaagaaacgaaggcccatatagaggagctacgccacctgtgggacctgctgttagagctgaccctggagaagggtgaccagttgctgcgggccctgaagttccagcagtatgtacaggagtgtgctgacatcttagagtggattggagacaaggaggctatagcgacatcagtggagctaggtgaagactgggagcgcaccgaagttctgcataagaaatttgaagacttccaagtggagctggtagctaaagaagggagagttgttgaagtgaaccaatatgccaatgagtgtgccgaggaaaaccatcctgacctacccttaattcagtctaagcaaaatgaggtgaatgctgcctgggagcgccttcgtggtttggctctccagagacagaaagctctgtccaatgctgcaaacttacaacgattcaaaagggatgtgactgaagccatccagtggatcaaggagaaggaacctgtactcacctctgaggactatggcaaagaccttgttgcctctgaaggactgtttcacagtcacaagggacttgagagaaatcttgctgtcatgagtgacaaggtgaaggagttatgtgctaaagcagagaagctgacactttcccatccttcagatgcacctcagatccaggagatgaaagaagatctggtctccagctgggagcatattcgtgccctggccaccagcagatatgaaaaactgcaggctacttattggtaccatcgattttcatctgactttgatgaactctcaggctggatgaacgagaagactgctgcgatcaatgctgatgagctgccaacagatgtggctggtggagaagttctgctggacaggcatcagcagcataagcatgagattgactcttacgatgaccgatttcaatctgctgatgagactggtcaagacctcgtgaatgccaatcatgaagcctctgatgaagttcgggaaaagatggaaatacttgacaacaactggactgccctgctggaactgtgggacgagcgtcatcgtcagtatgagcagtgcttggactttcatctcttctacagagacagtgagcaagtggacagttggatgagtagacaagaggccttcctggaaaacgaggatctgggaaactcactgggcagtgcagaagcccttcttcagaagcatgaagactttgaggaagcctttactgcccaggaagagaagatcataactgtagacaagactgcaaccaaattgattggtgatgaccattatgattcagagaacatcaaggctatccgtgacgggctgttagcccggcgggatgccctacgtgaaaaggctgccactagacgtagattgctgaaggagtcattgcttctgcaaaaactgtatgaggactcagatgacctaaagaactggatcaacaagaagaaaaagttggcagatgatgaagattacaaggacatacagaacttgaagagcagggttcaaaagcagcaagtctttgaaaaggagttggcagttaataagacccagctggaaaacatacagaaaactggccaagagatgattgagggtggtcactatgcctctgacaatgtgaccactcgtctgagtgaagttgccagcctctgggaggagttgctggaggctacaaaacagaaagggacccagttgcatgaggccaaccagcagctgcaatttgaaaataatgcagaagatttgcagcgctggctggaggatgttgagtggcaagtcacctctgaggattatgggaaaggcctggccgaggtacagaatcgactcaggaaacacggcctcctggagtcggctgtggctgctcgtcaggatcaggtggatatccttacagacctggctgcatattttgaagaaataggccatcctgattctaaggatataagggcaaggcaagagtccttggtatgccgatttgaagctctgaaagagccactggccacccgaaagaagaagctcttagaccttctccatctgcagctgatttgtagagacacagaggatgaggaggcctggatccaagagactgaaccctcagctacttccacctaccttggaaaggacctgattgcttccaaaaagcttctgaataggcatagagtcatcctggagaacattgccagccatgaaccacgcattcaagagataacagaaaggggaaacaaaatggtagaggaaggacactttgctgcagaagatgtggcctctagggtcaagagtttgaaccagaatatggagtctctccgtgctcgagctgctaggcgacaaaatgatcttgaagccaatgtccagttccagcagtacctggctgacctgcatgaagcagaaacatggatcagagagaaggaacctattgtagataatactaactatggtgctgatgaagaagcagctggggctcttctaaagaagcatgaggcctttctattagatctcaattcatttggagacagtatgaaagctctgcggaatcaggcaaacgcctgccagcaacaacaggctgcaccagtggagggagttgctggagaacaaagggtcatggctttatatgacttccaggcccgcagcccccgagaagtcaccatgaagaaaggtgatgtcttaacgctgctcagttccatcaataaggactggtggaaggtggaagctgctgatcatcagggcattgtcccagctgtctatgtcagaagactggcccacgatgagttcccgatgctcccacagcggcgacgagaagagccaggaaacatcacccagcgccaggagcagattgagaaccaataccgctccctcttggatcgggcagaagaacgcagacgtcgtctattgcaacgttataatgaatttttattggcctatgaggcaggagacatgctggaatggattcaagagaaaaaggcagaaaacactggagtggaactagatgatgtttgggagctgcagaaaaagtttgatgagttccaaaaggatttgaataccaatgagcctcggctaagggatatcaacaaggtagctgatgatctactatttgaaggacttctaacaccagaaggagctcaaatccggcaggaattgaattcccgctggggttctttgcagaggcttgcagatgaacagcggcagctgctgggcagtgcccatgctgttgaagtgtttcacagagaagcagatgacacgaaggagcagattgagaagaaatgccaggccctcagtgctgcagaccctggctcagatctgttcagtgttcaggctcttcagcgacggcatgagggctttgaaagggacctcgtacccctgggagataaggtgaccatactgggggagacagcagagcggctcagtgagtcccatccagatgccactgaggacctgcagagacagaaaatggagctgaatgaggcctgggaagacctgcaggggcgtacaaaggatcgtaaggagagcctaaatgaggcccagaaattctacctgttcctcagcaaggccagggatctgcagaactggatcagtagcattggtggcatggtatcatcacaggagctggccgaagacttaactggcatagagatcttgctggagagacatcaggagcaccgtgctgacatggaggcagaggctcccaccttccaggccttagaggacttcagtgcagaacttatcgacagtgggcaccatgctagccctgaaattgaaaaaaagcttcaagctgtcaagctagagagagatgatttggagaaggcttgggaaaaacgcaagaagatcctagaccagtgcctggagttgcagatgttccaggggaactgtgatcaagttgagagctggatggtggcacgtgagaattccctgaggtcagatgacaaaagttccttagacagtctggaggctttgatgaagaaacgggacgatttggacaaagcaatcactgcccaggaagggaagatcactgacctagaacattttgctgagagcctcattgctgatgaacactatgccaaagaagagattgctacgcggctccaacgtgtactagacaggtggaaggctctcaaagcacaactgattgatgagcggacaaagcttggagactatgccaacctaaaacaattctaccgagaccttgaggagctggaagaatggatcagtgagatgctgcccacagcctgtgatgaatcctacaaagacgccactaacattcagaggaaatacctgaaacaccagacctttgcacatgaagtcgatggccgatctgagcaggtgcatggcgtcatcaacctggggaactccctgattgagtgtagcgcttgtgatggcaatgaagaggccatgaaggagcaactggaacagctgaaggaacattgggatcatctgcttgagagaacaaatgacaaagggaagaagctcaatgaggccagtcgtcaacagaggttcaacacaagcatccgggactttgagttctggctctcagaggcagagacattgctggccatgaaagatcaggccagggacttggcttcagcaggaaacctactcaagaagcatcagctattggagagagagatgttggctcgagaggatgcactcaaggacctgaatacattggctgaagatttgctctccagcgggactttcaacgttgatcagattgtgaagaaaaaagataatgtcaacaagcgtttcctgaatgtccaagaattggcagctgcacaccacgaaaaattgaaagaggcctatgccttgttccagttcttccaggatctagatgatgaggaatcctggatagaggagaagttgatacgagtgagctcccaggactatgggagagatcttcagggggttcagaacttgctgaagaagcacaaacgcctagagggggagctggtggcccatgagcctgccatccagaatgtgctggatatggcagagaagctgaaagacaaggctgctgtggggcaagaggagatccagttgcggctggctcagtttgttgaacactgggagaagctcaaagagttggccaaggcccgaggacttaagttggaagaatccctagaatacttgcaattcatgcagaatgctgaggaagaggaagcttggatcaatgaaaagaatgctttggctgtccgaggagattgtggagatacattagctgctactcagagcttgctaatgaagcatgaagctttggaaaatgactttgctgtccatgagacccgagtacaaaatgtgtgtgcacaaggagaagacatcctaaataaggtgttgcaggaggaaagtcagaacaaagagatttcttccaagatagaggctctgaatgaaaagaccccttctctggctaaggcaatagctgcttggaagttgcaattggaagacgattatgcctttcaggaattcaactggaaggctgatgtggtagaggcttggatagctgataaggaaacaagcctaaagaccaatggcaatggtgcagaccttggtgacttcctcactcttctggcaaaacaggacactctggatgccagtctgcagagtttccagcaagagagacttcccgagatcactgacctgaaggacaaactgatttctgctcaacacaaccagtctaaagccattgaagagcgttatgccgctctgctgaagcgctgggaacagttgctggaagcctcggcagtccacagacagaaattgctggagaaacagctgcctctacagaaggctgaggacctgttcgtggaatttgcacataaggcttcagctttgaacaactggtgtgaaaagatggaagaaaacttgtcagagcctgtgcactgtgtctccctgaatgaaattcggcagctgcagaaagaccatgaggacttcttggcctccctggctagggctcaagcagactttaaatgtttgctggagctagaccagcagattaaggccttaggtgtgccttccagcccttatacctggttaacagtggaggtgctggaaaggacctggaagcacctatctgacatcattgaggaacgggagcaggagctgcaaaaggaagaggcaagacaggtcaagaactttgagatgtgtcaggagtttgaacagaatgccagtaccttccttcaatggatcctggaaaccagggcttactttctggatggatcattgctcaaagaaacaggaactctggaatctcagctggaagcaaataaaagaaaacagaaggagatccaggcgatgaagcgtcaactaaccaagattgtggacctgggggacaacttggaagacgctctgatccttgatatcaaatacagcaccattggattggctcagcagtgggaccagctctaccagcttgggttgcggatgcaacacaacctggagcaacagatccaggccaaggacatcaaaggtgtgagtgaagagactctaaaggaatttagcacaatctataaacactttgatgagaatttgacagggcgcctgactcacaaagagttccggtcctgcctgagaggactcaattactacttgcccatggtggaggaggatgaacatgagcccaagtttgagaagttcctggatgctgtggatccagggaggaagggctatgtctcactggaggactatactgctttcctgattgacaaggagtcagaaaacatcaagtccagtgatgaaatagagaatgccttccaagccctggcagagggcaagtcatatattaccaaagaagacatgaagcaggcccttaccccagagcaagtgtcattctgtgccacacatatgcagcaatatatggacccacggggtcgaagccatctctctggctatgactacgttggcttcaccaattcctactttggcaactaataagcagctcctcgtggatcgtagaaaatcttagtgtcgtgggaaatttactggggggcaaagagtacaggcaaatgtggaagataaagatggcctcgtgtgtgtgtgtgtgtgtgtgtgtgtgtgtgtgtgcttgtgtttgtgtgcatattacatttattgtaggatcttaaaaaatctcaagggtgggagatagaaaggttaatagagttggaggagtggaagctattttgtatgcaactagtcactgctgaggggtgtcaaagtttctatttttatttgttctgttttgcacgtctttatcattttgctttattccgattatagaataaagtaattctttttaaaaatattttttggggcaaagttaagtaaaatgttgagcttctatatttctgggaactgtactcatataagagtgggcagctaattttactgtaaagaagggccatggtatagtagataaataaaatccaaggcaattttcaaacaatttttttaaactttggaatgtgtttaaatttaaatttgaaaataaagatatttgattttctggggaacatgaatattttagtttgtacaatgaaacaacacacagatcagcataacacctgttttcttcttgttttttttccatacttcaaaattattgtagatgttattactctcagaaagacaaaattccagcatagcagggctttctcttgtcctccaagctcccgtattttctcttaagttttaatgtaataaaaataatacttcaatatcctgttaaa

SEQ ID NO: 29643 - DNA, 7872 bp, Homo sapiens
gccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgcactgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtctcatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccaggtaagccttatgttaagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctagcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaaccggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggtgccagcccgctggggcgtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttccccc

SEQ ID NO: 29644 - DNA, 7793 bp, Homo sapiens
actacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgcactgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcaatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtctcatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctagcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaaccggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggtgccagcccgctggggcgtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccc

SEQ ID NO: 29645 - DNA, 6863 bp, Homo sapiens
actacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgcactgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtctcatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagctttccaagctgctgagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctagcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaaccggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggtgccagcgtaaagatggccagttgcagggtggaagagtcggggaccctcgaatcccagcttga

SEQ ID NO: 29646 - DNA, 7857 bp, Homo sapiens
actacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgcactgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtctcatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctagcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaaccggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 29647 - DNA, 7872 bp, Homo sapiens
actacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgcactgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtctcatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagctttccaagctgctgagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctagcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaaccggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 29648 - DNA, 10168 bp, Homo sapiens
cagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctggaatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccattgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccgggggaagaagagggaacgtggcctcagaacctgcagcagccaccaccgccgggtcagcacaaggatgggcagaaatccactggggatgagaggcccaccacggagcccctctttaaggtcctagatacgcctctgagcgagggtgatgagcccgcaacgctgccggccccgcgggaccatgggcagagtgtgcagatggaaggctacctgggccgcaagcatgacctggaggggcccaacaagaaggcttccaacagtaagggagaagagggagaggagaggagggagacagaagaggaggatgaagaggaggaggaaacagagtctgttgctgtagaaatgcagcaacatgcttcccacgtgtcctggaacaacctgtactgtgtgctcaggaacagtgagctaaccttctacaaggatgccaagaacctggccctggggatgccctaccatggggaggaacccctggccctgagacatgccatctgtgagattgctgccaactacaagaagaagaagcacgtctttaagctgaggctgagtaatggcagcgagtggctcttccatggcaaggatgaggaggagatgctgtcctggctgcagggcgtgagcaccgccatcaacgagtcccagagcatccgcgtcaaggcgcagagcctgcccctgccttccctctccggccccgacgccagcctcggcaagaaagacaaggagaagagattcagcttcttccccaaaaagaagtagcaggtggggctggcgggcgcggcggagtcgggacgcgcagagaccgggcagcccaggccttggcctcctctcgccgccgcccgccggtcgaatcgagatgagtcgagtcgcgggccgggcccccgggccccacgctgcactgcaaaagctgccttcgcccgcgtgtcctgggccgacgccccctccatgccctcgcccgcgctggctccgctccagggacaggggctcccagctcctctggcgcctttggggcctccaggcctgggggcaggaaacggttctctgaggcacacgccctcctctcccaccctcctcctgagccgagggggcacaggccccttacccccaaccaaaaaaaaaaaaaaaaaagagctggagaaggctgatggggttcttcaaacgctgcccgttcctaaagcaagtcttgcttcgggtcacctcccacctggtggcagccagggaaaggggaaaggaagaagacactggaaatgcatggccagccccctaggggcatgaggaaggagccttcaggtggcccacaaagccctagctctgggccaggggctctggggggctgaggggaccagactgggtgcagggccttgggagctgccagcctccttcccactgggcttccgcagaactgggactctcacttcaggggccaccacatccctcctctctgcttctccccccagatcaaagggtaccctcccacggttggcagggcctggctgagtgcctctagcaccctttgtgccaccacaggcggtcccaggaagggcagcaaggtcagaccattcctcattgaaaaccgtggctagggcacagggctctgatctgaaggagtgacaggtgcgtcacaacactgcctaaggctctccctctcaatgctgggaccctcgccccactcccagtggcagccaaaccagcaatatccaacagacataggccccctacgggacagtgtgggcccccagatataagatggataccccccgcacctgcagtaaagcatcccaaagccaaatgctcaattgcatcctgtctgcagctgggactttggagggtaatggctgggcagacagtaaagttgatcatctgttttctcggggtggcagacgcagccatgtcttggtatcaccacccatgtgacagctactcctgcacaactgggacaaatgtcagggccagagccatgaaggtgtggtaccccttgatcagcttctccacgtcctggccccaggtcttggcggggagggggtcacatgagtacagaggtcaaatatctaccaccctccagccctgagcaccagaagctctgcaaccaacgtccccaggaatggccttccccttgctgctcaggtcatacttctggaggaagagaaagctcattccatattttccccaccactctactccgaaagcaacacagttctggcccagtatcaaactagggttaggtccaagagagcagtcaagcgggtcgggggtgggggggagggcggagggcagcaggcattttcccccaaggaaaccatgaaagtccccagggcctgcagtcaagtttctatcaccttccccgtgagaaggaccttagttccatggagatgaagtgggtgaggttcaggtagaagccacaggggcaggcatccagaatgaggccccctgaggaaccctgagtgctgaccagtgccggcagaaatcagttccaccctgtggccctgacactatatgtcagggtgacaccaactgcagcaggcaggagccacaggaaggaagacgtcatccgatggagcctgacatccccaggttcccgccctggtgagcaaggtcttcatttggctttggtacatatgaccctatacagggaacctagtgtgtatcactcaccagcctctttctgtatctggggaaaccaaggcagtgaggtgactgcactcacctagcaataaagtaggcctttggtgcacttgcaggcatgtcctcctctggggcagagagcaggttccttgctgaagggcagatggtggcaaacatctccctcaactgtttccctgggccagtctttagggagcctagggacaagggcccaccctcccccttccacgtgtgccaaatcagcacctgaagtgaggcatttccagcaagcaactccacagacccgagaaaggaagggctctagtggaagagctagcatctcaccaccccaggtcccctggcctggtccagggcagccagctgcatgtgaccattctgttgccagctccccacacatccctcctgtcacccaggctccaagacattcgaccaactagactgaaaatgcaggcatccagctttgggagaccctgtgtgtgccacaccagggctaagctctcccagtgccctagcaaggtctttttttttttttctctccttattctactctacagtcttttgacagtattcccaaacgaggttgacacagctccagtccacaccagcataccaggcttccttcccagggcagtttagaggaagctccttctgggcaaggtcaggcggtcctccttccctctctccttcccctttgtcccagcctcaactgactctggctgtgggaggtgtggagggtccttaggcttccctccccaacctggcctccaccaacacccctaacaggaggcccgtggaaggctcagcctctcctccgcatccctcctccttcctgcctatcggagggagccagggtcccctaggctgaccctgaatcctcttcctcccttcatgggaggggggcaggaatccagaggaggatgaagccagcgggaccacatggcttggtggcttggacaaacaagctcagggaggaaatgaggaggcggcggctgcagaggaatgcaaccctgttgggcacagaccatgcaatctggggctggccctggggccagctgggtcctgtcctccacctgctcaaccgtgcttccaccaaccagaggaaacccatttactagtttttctaataaatcaataatgctcc

SEQ ID NO: 29649 - DNA, 6375 bp, Homo sapiens
cagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctggaatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccattgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacggcctcaagaggaggaaggcgagacagcaggggaggctccagtttcccaccatgcggccaccgagagaacgtccccggtcagtctctggtctcgtttgtctag

SEQ ID NO: 29650 - DNA, 6705 bp, Homo sapiens
tgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctggaatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccattgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccggtcagtctctggtctcgtttgtctagttcctgggagtcactgcagccagagccctctcacccctactaggctcagcccaggtggaggcgagatgagctggcgcagccccgccctccatcctccccacatccctgcagccacctcccagcagagcaggctacgtcctcactgaggtgttcttcatgagagtactagcctcctccactcctccccacagcgcagaggaaacaggccagcccagtgacatgacgttattagttttgttttacctaatgtaataaattttattgtataaatatatcaccatttacatgaggggaaacacta

SEQ ID NO: 29651 - DNA, 10063 bp, Homo sapiens
cagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctggaatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccattgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccgggggaagaagagggaacgtggcctcagaacctgcagcagccaccaccgccgggtcagcacaaggatgggcagaaatccactggggatgagaggcccaccacggagcccctctttaaggtcctagatacgcctctgagcgagggtgatgagcccgcaacgctgccggccccgcgggaccatgggcagagtgtgcagatggaaggctacctgggccgcaagcatgacctggaggggcccaacaagaaggcttccaacaggtcctggaacaacctgtactgtgtgctcaggaacagtgagctaaccttctacaaggatgccaagaacctggccctggggatgccctaccatggggaggaacccctggccctgagacatgccatctgtgagattgctgccaactacaagaagaagaagcacgtctttaagctgaggctgagtaatggcagcgagtggctcttccatggcaaggatgaggaggagatgctgtcctggctgcagggcgtgagcaccgccatcaacgagtcccagagcatccgcgtcaaggcgcagagcctgcccctgccttccctctccggccccgacgccagcctcggcaagaaagacaaggagaagagattcagcttcttccccaaaaagaagtagcaggtggggctggcgggcgcggcggagtcgggacgcgcagagaccgggcagcccaggccttggcctcctctcgccgccgcccgccggtcgaatcgagatgagtcgagtcgcgggccgggcccccgggccccacgctgcactgcaaaagctgccttcgcccgcgtgtcctgggccgacgccccctccatgccctcgcccgcgctggctccgctccagggacaggggctcccagctcctctggcgcctttggggcctccaggcctgggggcaggaaacggttctctgaggcacacgccctcctctcccaccctcctcctgagccgagggggcacaggccccttacccccaaccaaaaaaaaaaaaaaaaaagagctggagaaggctgatggggttcttcaaacgctgcccgttcctaaagcaagtcttgcttcgggtcacctcccacctggtggcagccagggaaaggggaaaggaagaagacactggaaatgcatggccagccccctaggggcatgaggaaggagccttcaggtggcccacaaagccctagctctgggccaggggctctggggggctgaggggaccagactgggtgcagggccttgggagctgccagcctccttcccactgggcttccgcagaactgggactctcacttcaggggccaccacatccctcctctctgcttctccccccagatcaaagggtaccctcccacggttggcagggcctggctgagtgcctctagcaccctttgtgccaccacaggcggtcccaggaagggcagcaaggtcagaccattcctcattgaaaaccgtggctagggcacagggctctgatctgaaggagtgacaggtgcgtcacaacactgcctaaggctctccctctcaatgctgggaccctcgccccactcccagtggcagccaaaccagcaatatccaacagacataggccccctacgggacagtgtgggcccccagatataagatggataccccccgcacctgcagtaaagcatcccaaagccaaatgctcaattgcatcctgtctgcagctgggactttggagggtaatggctgggcagacagtaaagttgatcatctgttttctcggggtggcagacgcagccatgtcttggtatcaccacccatgtgacagctactcctgcacaactgggacaaatgtcagggccagagccatgaaggtgtggtaccccttgatcagcttctccacgtcctggccccaggtcttggcggggagggggtcacatgagtacagaggtcaaatatctaccaccctccagccctgagcaccagaagctctgcaaccaacgtccccaggaatggccttccccttgctgctcaggtcatacttctggaggaagagaaagctcattccatattttccccaccactctactccgaaagcaacacagttctggcccagtatcaaactagggttaggtccaagagagcagtcaagcgggtcgggggtgggggggagggcggagggcagcaggcattttcccccaaggaaaccatgaaagtccccagggcctgcagtcaagtttctatcaccttccccgtgagaaggaccttagttccatggagatgaagtgggtgaggttcaggtagaagccacaggggcaggcatccagaatgaggccccctgaggaaccctgagtgctgaccagtgccggcagaaatcagttccaccctgtggccctgacactatatgtcagggtgacaccaactgcagcaggcaggagccacaggaaggaagacgtcatccgatggagcctgacatccccaggttcccgccctggtgagcaaggtcttcatttggctttggtacatatgaccctatacagggaacctagtgtgtatcactcaccagcctctttctgtatctggggaaaccaaggcagtgaggtgactgcactcacctagcaataaagtaggcctttggtgcacttgcaggcatgtcctcctctggggcagagagcaggttccttgctgaagggcagatggtggcaaacatctccctcaactgtttccctgggccagtctttagggagcctagggacaagggcccaccctcccccttccacgtgtgccaaatcagcacctgaagtgaggcatttccagcaagcaactccacagacccgagaaaggaagggctctagtggaagagctagcatctcaccaccccaggtcccctggcctggtccagggcagccagctgcatgtgaccattctgttgccagctccccacacatccctcctgtcacccaggctccaagacattcgaccaactagactgaaaatgcaggcatccagctttgggagaccctgtgtgtgccacaccagggctaagctctcccagtgccctagcaaggtctttttttttttttctctccttattctactctacagtcttttgacagtattcccaaacgaggttgacacagctccagtccacaccagcataccaggcttccttcccagggcagtttagaggaagctccttctgggcaaggtcaggcggtcctccttccctctctccttcccctttgtcccagcctcaactgactctggctgtgggaggtgtggagggtccttaggcttccctccccaacctggcctccaccaacacccctaacaggaggcccgtggaaggctcagcctctcctccgcatccctcctccttcctgcctatcggagggagccagggtcccctaggctgaccctgaatcctcttcctcccttcatgggaggggggcaggaatccagaggaggatgaagccagcgggaccacatggcttggtggcttggacaaacaagctcagggaggaaatgaggaggcggcggctgcagaggaatgcaaccctgttgggcacagaccatgcaatctggggctggccctggggccagctgggtcctgtcctccacctgctcaaccgtgcttccaccaaccagaggaaacccatttactagtttttctaataaatcaataatgctcc

SEQ ID NO: 29652 - DNA, 10063 bp, Homo sapiens; identical to SEQ ID NO: 29651

SEQ ID NO: 29653 - DNA, 6768 bp, Homo sapiens
cgccacccccgggctcggggtggcccccgcttcagtcccagggcagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctggaatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccattgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccggtcagtctctggtctcgtttgtctagttcctgggagtcactgcagccagagccctctcacccctactaggctcagcccaggtggaggcgagatgagctggcgcagccccgccctccatcctccccacatccctgcagccacctcccagcagagcaggctacgtcctcactgaggtgttcttcatgagagtactagcctcctccactcctccccacagcgcagaggaaacaggccagcccagtgacatgacgttattagttttgttttacctaatgtaataaattttattgtataaatatatcaccatttacatgaggggaaacact

SEQ ID NO: 29654 - DNA, 7481 bp, Homo sapiens
gtgccaggagccccgcgctgccctcctccccctgcgccgccgccgccgccacccccgggctcggggtggcccccgcttcagtcccagggcagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctggaatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccattgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccgggggaagaagagggaacgtggcctcagaacctgcagcagccaccaccgccgggtcagcacaaggatgggcagaaatccactggggatgagaggcccaccacggagcccctctttaaggtcctagatacgcctctgagcgagggtgatgagcccgcaacgctgccggccccgcgggaccatgggcagagtgtgcagatggaaggctacctgggccgcaagcatgacctggaggggcccaacaagaaggcttccaacaggtcctggaacaacctgtactgtgtgctcaggaacagtgagctaaccttctacaaggatgccaagaacctggccctggggatgccctaccatggggaggaacccctggccctgagacatgccatctgtgagattgctgccaactacaagaagaagaagcacgtctttaagctgaggctgagtaatggcagcgagtggctcttccatggcaaggatgaggaggagatgctgtcctggctgcagggcgtgagcaccgccatcaacgagtcccagagcatccgcgtcaaggcgcagagcctgcccctgccttccctctccggccccgacgccagcctcggcaagaaagacaaggagaagagattcagcttcttccccaaaaagaagtagcaggtggggctggcgggcgcggcggagtcgggacgcgcagagaccgggcagcccaggccttggcctcctctcgccgccgcccgccggtcgaatcgagatgagtcgagtcgcgggccgggcccccgggccccacgctgcactgcaaaagctgccttcgcccgcgtgtcctgggccgacgccccctccatgccctcgcccgcgctggctccgctccagggacaggggctcccagctcctctggcgcctttggggcctccaggcctgggggcaggaaacggttctctgaggcacacgccctcctctcccaccctcctcctgagccgagggggcacaggccccttacccccaacc

SEQ ID NO: 29655 - DNA, 9075 bp, Homo sapiens
ggtgtgcgcgctgcgcccgcgagctcccgggctcggcaaccgtggcatgcttaggattggccatatttaaaagttctgaagtagaacctgcgcctcctctctgcttctccctcctcctcagtaatttatttcgagcttccaggcaagggccacggaagaagggaaagcaagaaattagatgcctgtgtggtaactcctcgcggagctaaggtggactctcttgcagccaacttcccatcagatcaccctgctggacttgcagaccggaatggggctcgcctaaggagccgagcgctgcggaggctgctgcgtgttggatgggagtgggagggggctggagcgagatttccagggcgcagtcctccggggcgttacgccgggcataatggaattgcagaggacgtctagtatctccgggccgctgtcgccggcgtacacggggcaggtgccttacaactacaaccagctggaaggcagattcaagcagctgcaagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacgggttagttaccgctctcaaacctaccaaaactacaaaaactttaatagcagacggacagccagtgaccagccatggtctggactgtgaagttcactaccatttgtcaagaatcaccctttccaaatcctctgggttttgactttttggcttccacttcacccaaaatgttaaaatttttacttaattcatagccttccttggtttcatatttgtttgcatttaattcatgtttgagtctcttaactgatggatgcccacttgccttaaagcagcatacttattttttgtttatttattgtgagctttttactttattaagattttacagcgaaacccttacatgagtaattgaaatgaaattaaatgagattacagcataatgaagaagaaaactagaatctaacaggtatgacacattcagttattctaacagggcacagtactgtgctatatgtagccgcctttacagatgttattaacctatagtagtttactattaactaggaagactggtgtatgaggagggagacattctgtaataagattaaaacctaaagtcagctgtgtaacattccatgaaagatgcattcatttattgaagatgacaaaaaagggagtcagatatattctggaagctattttaattttaggcacacaatctcatacattttgagacccttgggtcatttattactttttacaaactagttcctctctttttttctgccaagtcctgaattgaaaactgtaggcttccttgcacagatgttgcagccagcctcaggagtaaagtgcccgctgactgctgccgccacctctgtctcgctccctgtcagtgctgctggcacgtgggacgcggcaggtgacagccgttctcagcatgttttagaagcttgcctcacagacttccatgcctctccattcagccgatgacttcagggtgtcaaactgttttaatttttcaaacaaatggaacagaagccattgtggttcatcctgattacttgaacgttgcacttggtggaccgtgcctgggagcgctcgcatgccccctggcttcagaagtcatgtcagtgtctctgtagacaaactccactgtacatcttggattaatcttctgattcattgttcattttctcaagactttttgtggaattctctgataaaggaagcttttaggatggtatctatcaggccaccagcaggaattgaaaatgttttcacaaaaatccttttccttagaaataaaagctggtgacagagatggtttccttgtaccgataaaaacaaaaccaaatccatattatacatcaaaaccttgtgagacattcacttgctcttttgccatatttagatgtgtcagtggaatcagaaacctgttttgatatgtgttctctatgagttaagtctgatttgtctttttatttcatgatgcatgtcttttttttcttttgtcaggataacgtcatatagcatcttgtttgtttttccttatctctatgtacatatctatctacttctgactgtagatgggtatatagatagatgccaagcttcttatgttctgggggtagtatgcatcattattgggtctctgccttaaaacacatcaaaattcattttagacaaaaaaacttctgctttgtctttggtcattagggagctctaatgtgtgtttgtggctccaagttacattttgtgtttcattgatctatatgtatatatgtgatgttttcatatatatatgtgtgtgtgtttaaattttgtatcatcaggactgacacccaatttgacactttttgtatctagaagaccctccaaaaaaggaaccacataagcacacaagaaaagagtgctatgatgttcttagcatttgctatcatgcctatttttatctagatttttaaatgtagcttgtcataacaaaattttaattacaattggcttgtatgagaagaaaaagtatttttattgttttgagtgatgacgcagagactcagtgaacttgaaaatagcattgcttcgtgcactttgaataccaatcaggtgttttctgtgctactagttgtcacgttgcattcatgttcacctcctgatttaagtatctcgggtgtgcccagccactaaagcactctggactaatcgctaaagagaagcaacgtggggggtggggttgcgagggatgtgttcacatgtacccatcatttgatcatagcactgtgattgcttttgatgtgtgtctctagtggtgtgctgtctgttggcatgcttaaagcacatgtccattaaaattcattttgttcctttta

SEQ ID NO: 29656 - DNA, 8482 bp, Homo sapiens
ggaatcagtgccgctgttgccgtgcaggctgcggattcctccagtccctccctcggccgcctctcctcccggagcgagcgcgcagccctgcgcagcagcgcccactggtcccgtcctgtgagccccggccccagccgcggacagacccgcggagtcgcctcccggcccacccgcccggccgccgaggagcgggaggaggacgggaccccggcgcccccaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatcta

SEQ ID NO: 29657 - DNA, 2164 bp, Homo sapiens
cttcaacaggtttgtctcagcgcagggaccctccgggcctgctttggaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgc

SEQ ID NO: 29658 - DNA, 7866 bp, Homo sapiens
ccactgagcagccaaccgcagcctctggccacaaggagagcggagcacaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggagaacgtggacaaggcactgcagttcctcaaggagcagaaagtgcacttggaaaacatgggctcccatgacattgtggacggaaaccaccgactgacccttgggctggtctggaccatcatccttcgattccagatccaagacatcagtgtggagacagaagacaacaaggagaagaagtcagccaaggatgccctgcttctgtggtgccagatgaagactgcaggttatcccaacgtcaatgtacacaacttcaccaccagctggagagatggactagctttcaacgccatcgtgcataaacaccggccagacctgctggattttgagtctctgaagaagtgtaatgcacactataatctgcagaatgcattcaatctggctgaaaaggaactgggacttaccaagctgctggatcccgaagacgtgaatgtggaccagccagatgagaagtcaatcattacctatgtggctacttactaccattacttctccaagatgaaggccctggccgtggaaggcaagagaattggcaaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtttaccgagaaagggaacttggaagtgctgctcttcaccatccagagcaagcttcgggccaacaaccagaaggtctacacgccccgcgagggccggctcatctcggacatcaacaaggcttgggagcggctggagaaggcggagcacgagcgtgagctggccctgcgcaccgagctcatccgccaggagaagctggagcagctggccgcccgcttcgaccgcaaggctgccatgcgggagacctggctcagcgagaaccagcgcctcgtgtcccaggacaactttgggctggagctggcagctgtcgaggcagcagtacggaagcacgaagccattgagacggacatcgtggcctacagcggccgggtgcaggcagtggacgccgtggctgcagagctggccgccgagcgctaccacgacatcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaagggccggctgcagtctcaggacctgggcaggcacctagcaggagtggaggacctgctgcagctgcacgagctggtggaggcagacatcgccgtgcaggccgagagggtgcgggccgtcagcgcctctgccctgcgcttctgcaacccagggaaagagtatagaccttgcgacccgcagctggtgtcggagcgggtggccaagctagagcagagctatgaggcactgtgcgagttggcagcggcgcggcgggcccggctggaggaatcacggcggctctggcgtttcctctgggaggtgggtgaagctgaggcctgggtgcgggagcagcagcacctcctggcctcagccgacacgggccgagacctgaccggtgccctccgcctgctcaacaagcacacagccctgcggggcgagatgagcggccggctggggcccctgaagctcaccctggagcagggccagcagttggtggccgagggtcaccctggggcaagccaggcctctgcccgtgcagctgaactccaagcccagtgggagcggctagaggccctggccgaggagcgtgcccagcggctggcccaagccgccagcctctaccagttccaggccgatgcaaacgacatggaggcctggttggttgacgcactgcgcctggtgtccagccccgagctggggcacgacgagttctccacgcaggctctagccaggcagcatcgggccctggaggaggagattcgaagccaccggccaaccctggacgccttgagggaacaggcagcagccctgccccccacactgagccgcacgcccgaggtgcagagccgggtgcccaccctggagcggcactacgaggagctgcaggcccgggcaggcgagcgagcgcgggccttggaggcagccctggcgctctacaccatgctcagcgaggccggggcctgtggactctgggtggaggagaaggagcagtggctcaacgggctggccctgcctgaacgcctggaggacctggaggtcgtgcagcagaggttcgagaccctggagcctgaaatgaacacccttgcagcacaaatcaccgcggtgaatgacattgccgagcagttactgaaggccaaccccccaggcaaagaccgcattgtcaacacccaggagcagctcaaccacaggtggcagcagtttcggcgtctggcagacggcaagaaggcagctctcacctcagccctgagcatccagaactaccacttagagtgcacggagacccaggcctggatgagagagaagaccaaagtcatcgagtccacccagggcctaggcaacgatctggctggggtgctggccctgcagcgcaagctggccggcacggagcgggacctggaggccatcgccgcccgggtgggcgaactgactcgagaggcaaatgccctggctgccggccatcccgctcaggcagtggccatcaacgcccggctgagagaggtgcagaccggctgggaggacctcagggccaccatgcggcgtcgagaagagtcgctgggggaggcgcggcggctgcaggacttcttgcgcagcttggatgacttccaggcctggctaggccgcactcagactgctgtggcctctgaagaagggccggccaccctgcctgaggcagaggccctcctggcccaacatgcagccctgcggggagaggtggagcgggcccagagcgagtatagccggctgcgagccctgggcgaggaggtgacccgggaccaggctgacccccagtgcctcttcctacgacagcgactggaggccctgggaactggctgggaggagctgggccgaatgtgggagagccggcaaggtcgcctggcccaggcccacggcttccagggattcctgcgggatgctcgtcaggctgagggcgtgctcagcagccaggaatatgttctgtctcacacggagatgccagggacactccaggctgctgatgctgccattaaaaaactggaggacttcatgagcaccatggacgccaatggggaacggatccacgggctcctggaggctggccgccagctggtatctgaaggcaacatccacgccgacaagattcgggaaaaggcagactccattgagaggaggcacaagaagaatcaagacgcagcgcagcaatttctgggccgtcttcgggacaaccgggagcagcagcatttcctgcaagattgtcacgagctgaagctctggatcgacgagaagatgctgacagcccaggacgtgtcctatgacgaggcccgcaacctgcatactaagtggcagaagcaccaggcattcatggccgagctggctgccaacaaagactggctggacaaggtggacaaggaagggcgagagctcacccttgagaagccagagctgaaagccctggtgtcggagaagctgagagacctgcacaggcgctgggacgagctggagaccaccacccaagccaaggcccgcagcctctttgatgccaaccgagctgagctgtttgcccagagctgctgtgccctggagagctggctggagagcctgcaggcccagctgcactcggatgactacggcaaggacctcaccagcgtcaacatcctgctcaagaagcagcagatgctggaatgggagatggctgtgagagagaaggaggtggaggcaatccaggcccaggccaaagcactggcccaggaggaccagggtgcaggggaggtggagagaacctcgagggccgtggaggagaagttcagggccttgtgccagcccatgcgggaacgctgccggcgcctgcaggcttctcgcgagcagcaccagttccaccgcgatgtggaagatgagattttgtgggtgacagagcggctgcccatggccagctccatggagcatggcaaggacctgcccagcgtccagcttctcatgaagaaaaaccagaccctgcagaaagagattcagggccatgagccccggatcgcggacctgagggagcggcagcgtgctctaggtgcagcagcagcaggtccagagctggctgagctgcaggaaatgtggaaacgcctgggccacgagctggaacttcgagggaagcgactggaggatgccctgcgagcccagcagttctaccgcgatgccgccgaggcggaggcctggatgggcgagcaggaattacacatgatgggccaggagaaggccaaggatgagctgagtgcccaggcagaggtgaagaagcaccaggtgctggagcaagccctggccgactacgcgcagaccatccaccagctggcggccagcagccaggacatgattgaccacgagcacccagagagcactcggatatccatccgccaagcccaggtggacaagctgtatgccggcctgaaggagctggctggagagcggcgggagcgcctgcaggagcacctccggctgtgccagctccgccgcgagctggatgacctggaacagtggatccaggagcgcgaggtggtggcggcctcccacgagctgggccaggactacgagcatgtgactatgctccgagacaaattccgagagttctcccgggacacaagcaccatcggtcaggagcgcgtagatagcgccaatgcgctggccaatgggctcattgctgggggccatgctgcacgggccaccgtggccgagtggaaggacagtctcaacgaggcctgggctgacctgcttgagctgctggacacacggggtcaggtgctggccgcggcgtacgagctgcagcgcttcctgcacggggcacgccaagccctggcgcgggtgcagcacaagcagcagcagcttccggacgggactggccgcgacctcaacgctgccgaggccctgcagcgccgacactgtgcctacgagcatgacattcaggccctcagcccccaggtccagcaggtgcaggacgacggccaccggctccagaaggcctacgctggagacaaggctgaggagatcggccgccacatgcaggccgtggccgaggcctgggcccagcttcagggaagctctgccgcccgccggcagctgctgctggacaccacagacaagttccgcttcttcaaggctgtccgggaactgatgctctggatggatgaggtcaacctgcagatggatgcccaggagcgtccccgggatgtgtcctccgcggatctagtcatcaagaaccagcaaggcatcaaggcagagatagaggcccgggcagaccgcttctcctcctgcatcgacatggggaaggagctgctggccaggagccactatgcggccgaggagatctcagagaagctgtctcagctgcaggcacggcgccaggagacagctgagaagtggcaggagaagatggactggcttcagctggttttggaggtgcttgtgtttggaagagatgcagggatggcagaggcctggctctgcagccaggagccactggtgcgcagcgctgagctgggttgcacggtcgacgaagttgagagcctcatcaagcggcacgaggccttccagaagtcagcagtggcctgggaggagcgattctgtgcgctggagaagcttactgcgctagaggagcgggagaaggagcgaaagagaaagagggaggaggaggagcggcggaaacagccgcctgctcccgaacccacagccagtgtgcctccaggggacctggtgggcggccagacagcttctgacaccacctgggacggaacccagccacggccaccaccatccacacaagcacccagtgttaatggagtctgcacagatggagagccctcacagcccctgctgggacaacagagacttgagcacagcagcttccccgaagggccgggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctgggcttacaggatggaaaagaatatttattccaggccaaggatgaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggtaaccccctctcccacccccgccgacttctcccctttccccagcctcgtgcctctgtccctcaccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccacccccaccctgtaactccagctgccactccatctccagctgctctcaatggcttccaggtgtgttgttcggggacagccaccgccttgagtctggccaaggaggtgattaaacagctcagcttctctc

SEQ ID NO: 29659 - DNA, 2890 bp, Homo sapiens
cacaaggagagcggagcacaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggagaacgtggacaaggcactgcagttcctcaaggagcagaaagtgcacttggaaaacatgggctcccatgacattgtggacggaaaccaccgactgacccttgggctggtctggaccatcatccttcgattccagatccaagacatcagtgtggagacagaagacaacaaggagaagaagtcagccaaggatgccctgcttctgtggtgccagatgaagactgcaggttatcccaacgtcaatgtacacaacttcaccaccagctggagagatggactagctttcaacgccatcgtgcataaacaccggccagacctgctggattttgagtctctgaagaagtgtaatgcacactataatctgcagaatgcattcaatctggctgaaaaggaactgggacttaccaagctgctggatcccgaagacgtgaatgtggaccagccagatgagaagtcaatcattacctatgtggctacttactaccattacttctccaagatgaaggccctggccgtggaaggcaagagaattggcaaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtttaccgagaaagggaacttggaagtgctgctcttcaccatccagagcaagcttcgggccaacaaccagaaggtctacacgccccgcgagggccggctcatctcggacatcaacaaggcttgggagcggctggagaaggcggagcacgagcgtgagctggccctgcgcaccgagctcatccgccaggagaagctggagcagctggccgcccgcttcgaccgcaaggctgccatgcgggagacctggctcagcgagaaccagcgcctcgtgtcccaggacaactttgggctggagctggcagctgtcgaggcagcagtacggaagcacgaagccattgagacggacatcgtggcctacagcggccgggtgcaggcagtggacgccgtggctgcagagctggccgccgagcgctaccacgacatcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaagggccggctgcagtctcaggacctgggcaggcacctagcaggagtggaggacctgctgcagctgcacgagctggtggaggcagacatcgccgtgcaggccgagagggtgcgggccgtcagcgcctctgccctgcgcttctgcaacccagggaaagagtatagaccttgcgacccgcagctggtgtcggagcgggtggccaagcttactgcgctagaggagcgggagaaggagcgaaagagaaagagggaggaggaggagcggcggaaacagccgcctgctcccgaacccacagccagtgtgcctccaggggacctggtgggcggccagacagcttctgacaccacctgggacggaacccagccacggccaccaccatccacacaagcacccagtgttaatggagtctgcacagatggagagccctcacagcccctgctgggacaacagagacttgagcacagcagcttccccgaagggccgggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctgggcttacaggatggaaaagaatatttattccaggccaaggatgaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcagg

SEQ ID NO: 29660 - DNA, 859 bp, Homo sapiens
tgatttgggcataattccttcctctcctaagcaggcagcagttcaccttggttaaggaccttggaccttagaccactcagacgctaacaaaccaaggagaaacccagccgtgtcaggcctagaaatgtctgcccccacccccacccccctcaagacggtgactaggccggaattctcctggttgataaatgagaggagctgagaagcgctgagatgcctgtttggagcatctgatctgtagaagacgaatcttcactgtgccatggagatgttctgggagggagagccggcccagctgcctgaaggaggacgcgagagcgaggggacgggtgagaggaatgcttagcggagacggactggaggtgcccggagaggaaaggggaacggaggctggatctcgggaaacctcgtcggcagtgtcattagaggaaggatcgcgtgtctcggggatacggattttggaggaaaagcagaatagggacaaaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggag

SEQ ID NO: 29661 - DNA, 8085 bp, Homo sapiens
atgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggagaacgtggacaaggcactgcagttcctcaaggagcagaaagtgcacttggaaaacatgggctcccatgacattgtggacggaaaccaccgactgacccttgggctggtctggaccatcatccttcgattccagatccaagacatcagtgtggagacagaagacaacaaggagaagaagtcagccaaggatgccctgcttctgtggtgccagatgaagactgcaggttatcccaacgtcaatgtacacaacttcaccaccagctggagagatggactagctttcaacgccatcgtgcataaacaccggccagacctgctggattttgagtctctgaagaagtgtaatgcacactataatctgcagaatgcattcaatctggctgaaaaggaactgggacttaccaagctgctggatcccgaagacgtgaatgtggaccagccagatgagaagtcaatcattacctatgtggctacttactaccattacttctccaagatgaaggccctggccgtggaaggcaagagaattggcaaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtttaccgagaaagggaacttggaagtgctgctcttcaccatccagagcaagcttcgggccaacaaccagaaggtctacacgccccgcgagggccggctcatctcggacatcaacaaggcttgggagcggctggagaaggcggagcacgagcgtgagctggccctgcgcaccgagctcatccgccaggagaagctggagcagctggccgcccgcttcgaccgcaaggctgccatgcgggagacctggctcagcgagaaccagcgcctcgtgtcccaggacaactttgggctggagctggcagctgtcgaggcagcagtacggaagcacgaagccattgagacggacatcgtggcctacagcggccgggtgcaggcagtggacgccgtggctgcagagctggccgccgagcgctaccacgacatcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaagggccggctgcagtctcaggacctgggcaggcacctagcaggagtggaggacctgctgcagctgcacgagctggtggaggcagacatcgccgtgcaggccgagagggtgcgggccgtcagcgcctctgccctgcgcttctgcaacccagggaaagagtatagaccttgcgacccgcagctggtgtcggagcgggtggccaagctagagcagagctatgaggcactgtgcgagttggcagcggcgcggcgggcccggctggaggaatcacggcggctctggcgtttcctctgggaggtgggtgaagctgaggcctgggtgcgggagcagcagcacctcctggcctcagccgacacgggccgagacctgaccggtgccctccgcctgctcaacaagcacacagccctgcggggcgagatgagcggccggctggggcccctgaagctcaccctggagcagggccagcagttggtggccgagggtcaccctggggcaagccaggcctctgcccgtgcagctgaactccaagcccagtgggagcggctagaggccctggccgaggagcgtgcccagcggctggcccaagccgccagcctctaccagttccaggccgatgcaaacgacatggaggcctggttggttgacgcactgcgcctggtgtccagccccgagctggggcacgacgagttctccacgcaggctctagccaggcagcatcgggccctggaggaggagattcgaagccaccggccaaccctggacgccttgagggaacaggcagcagccctgccccccacactgagccgcacgcccgaggtgcagagccgggtgcccaccctggagcggcactacgaggagctgcaggcccgggcaggcgagcgagcgcgggccttggaggcagccctggcgctctacaccatgctcagcgaggccggggcctgtggactctgggtggaggagaaggagcagtggctcaacgggctggccctgcctgaacgcctggaggacctggaggtcgtgcagcagaggttcgagaccctggagcctgaaatgaacacccttgcagcacaaatcaccgcggtgaatgacattgccgagcagttactgaaggccaaccccccaggcaaagaccgcattgtcaacacccaggagcagctcaaccacaggtggcagcagtttcggcgtctggcagacggcaagaaggcagctctcacctcagccctgagcatccagaactaccacttagagtgcacggagacccaggcctggatgagagagaagaccaaagtcatcgagtccacccagggcctaggcaacgatctggctggggtgctggccctgcagcgcaagctggccggcacggagcgggacctggaggccatcgccgcccgggtgggcgaactgactcgagaggcaaatgccctggctgccggccatcccgctcaggcagtggccatcaacgcccggctgagagaggtgcagaccggctgggaggacctcagggccaccatgcggcgtcgagaagagtcgctgggggaggcgcggcggctgcaggacttcttgcgcagcttggatgacttccaggcctggctaggccgcactcagactgctgtggcctctgaagaagggccggccaccctgcctgaggcagaggccctcctggcccaacatgcagccctgcggggagaggtggagcgggcccagagcgagtatagccggctgcgagccctgggcgaggaggtgacccgggaccaggctgacccccagtgcctcttcctacgacagcgactggaggccctgggaactggctgggaggagctgggccgaatgtgggagagccggcaaggtcgcctggcccaggcccacggcttccagggattcctgcgggatgctcgtcaggctgagggcgtgctcagcagccaggaatatgttctgtctcacacggagatgccagggacactccaggctgctgatgctgccattaaaaaactggaggacttcatgagcaccatggacgccaatggggaacggatccacgggctcctggaggctggccgccagctggtatctgaaggcaacatccacgccgacaagattcgggaaaaggcagactccattgagaggaggcacaagaagaatcaagacgcagcgcagcaatttctgggccgtcttcgggacaaccgggagcagcagcatttcctgcaagattgtcacgagctgaagctctggatcgacgagaagatgctgacagcccaggacgtgtcctatgacgaggcccgcaacctgcatactaagtggcagaagcaccaggcattcatggccgagctggctgccaacaaagactggctggacaaggtggacaaggaagggcgagagctcacccttgagaagccagagctgaaagccctggtgtcggagaagctgagagacctgcacaggcgctgggacgagctggagaccaccacccaagccaaggcccgcagcctctttgatgccaaccgagctgagctgtttgcccagagctgctgtgccctggagagctggctggagagcctgcaggcccagctgcactcggatgactacggcaaggacctcaccagcgtcaacatcctgctcaagaagcagcagatgctggaatgggagatggctgtgagagagaaggaggtggaggcaatccaggcccaggccaaagcactggcccaggaggaccagggtgcaggggaggtggagagaacctcgagggccgtggaggagaagttcagggccttgtgccagcccatgcgggaacgctgccggcgcctgcaggcttctcgcgagcagcaccagttccaccgcgatgtggaagatgagattttgtgggtgacagagcggctgcccatggccagctccatggagcatggcaaggacctgcccagcgtccagcttctcatgaagaaaaaccagaccctgcagaaagagattcagggccatgagccccggatcgcggacctgagggagcggcagcgtgctctaggtgcagcagcagcaggtccagagctggctgagctgcaggaaatgtggaaacgcctgggccacgagctggaacttcgagggaagcgactggaggatgccctgcgagcccagcagttctaccgcgatgccgccgaggcggaggcctggatgggcgagcaggaattacacatgatgggccaggagaaggccaaggatgagctgagtgcccaggcagaggtgaagaagcaccaggtgctggagcaagccctggccgactacgcgcagaccatccaccagctggcggccagcagccaggacatgattgaccacgagcacccagagagcactcggatatccatccgccaagcccaggtggacaagctgtatgccggcctgaaggagctggctggagagcggcgggagcgcctgcaggagcacctccggctgtgccagctccgccgcgagctggatgacctggaacagtggatccaggagcgcgaggtggtggcggcctcccacgagctgggccaggactacgagcatgtgactatgctccgagacaaattccgagagttctcccgggacacaagcaccatcggtcaggagcgcgtagatagcgccaatgcgctggccaatgggctcattgctgggggccatgctgcacgggccaccgtggccgagtggaaggacagtctcaacgaggcctgggctgacctgcttgagctgctggacacacggggtcaggtgctggccgcggcgtacgagctgcagcgcttcctgcacggggcacgccaagccctggcgcgggtgcagcacaagcagcagcagcttccggacgggactggccgcgacctcaacgctgccgaggccctgcagcgccgacactgtgcctacgagcatgacattcaggccctcagcccccaggtccagcaggtgcaggacgacggccaccggctccagaaggcctacgctggagacaaggctgaggagatcggccgccacatgcaggccgtggccgaggcctgggcccagcttcagggaagctctgccgcccgccggcagctgctgctggacaccacagacaagttccgcttcttcaaggctgtccgggaactgatgctctggatggatgaggtcaacctgcagatggatgcccaggagcgtccccgggatgtgtcctccgcggatctagtcatcaagaaccagcaaggcatcaaggcagagatagaggcccgggcagaccgcttctcctcctgcatcgacatggggaaggagctgctggccaggagccactatgcggccgaggagatctcagagaagctgtctcagctgcaggcacggcgccaggagacagctgagaagtggcaggagaagatggactggcttcagctggttttggaggtgcttgtgtttggaagagatgcagggatggcagaggcctggctctgcagccaggagccactggtgcgcagcgctgagctgggttgcacggtcgacgaagttgagagcctcatcaagcggcacgaggccttccagaagtcagcagtggcctgggaggagcgattctgtgcgctggagaagcttactgcgctagaggagcgggagaaggagcgaaagagaaagagggaggaggaggagcggcggaaacagccgcctgctcccgaacccacagccagtgtgcctccaggggacctggtgggcggccagacagcttctgacaccacctgggacggaacccagccacggccaccaccatccacacaagcacccagtgttaatggagtctgcacagatggagagccctcacagcccctgctgggacaacagagacttgagcacagcagcttccccgaagggccgggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctgggcttacaggatggaaaagaatatttattccaggccaaggatgaggtgagctgtccttcgtgttcctctctgtccgtgccattccagaagcttccagctgcagactccccttctttccctgtcctccctctttttcctggtcttgtcctttgtggtaagactggatgtgtgcgacggccgcaccaggccgcactccctgtctaagccggccacattctcctaatagcatgaaacagtcagctcactttctgcctcctcctcttacacttccctgctgtccactgcggccaactcagcacagtgtccttgaagctgattgagggtctttccatccacaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggtaaccccctctcccacccccgccgacttctcccctttccccagcctcgtgcctctgtccctcaccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccacccccaccctgtaactccagctgccactccatctccagctgctctcaatggcttccaggtgtgttgttcggggacagccaccgccttgagtctggccaaggaggtgattaaacagctcagcttctc

SEQ ID NO: 29662 - DNA, 8128 bp, Homo sapiens
gatgttctgggagggagagccggcccagctgcctgaaggaggacgcgagagcgaggggacgggtgagaggaatgcttagcggagacggactggaggtgcccggagaggaaaggggaacggaggctggatctcgggaaacctcgtcggcagtgtcattagaggaaggatcgcgtgtctcggggatacggattttggaggaaaagcagaatagggacaaaggcttcccaggtggcttcccctcttcccctgggggctgatttccactgagcagccaaccgcagcctctggccacaaggagagcggagcacaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggagaacgtggacaaggcactgcagttcctcaaggagcagaaagtgcacttggaaaacatgggctcccatgacattgtggacggaaaccaccgactgacccttgggctggtctggaccatcatccttcgattccagatccaagacatcagtgtggagacagaagacaacaaggagaagaagtcagccaaggatgccctgcttctgtggtgccagatgaagactgcaggttatcccaacgtcaatgtacacaacttcaccaccagctggagagatggactagctttcaacgccatcgtgcataaacaccggccagacctgctggattttgagtctctgaagaagtgtaatgcacactataatctgcagaatgcattcaatctggctgaaaaggaactgggacttaccaagctgctggatcccgaagacgtgaatgtggaccagccagatgagaagtcaatcattacctatgtggctacttactaccattacttctccaagatgaaggccctggccgtggaaggcaagagaattggcaaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtttaccgagaaagggaacttggaagtgctgctcttcaccatccagagcaagcttcgggccaacaaccagaaggtctacacgccccgcgagggccggctcatctcggacatcaacaaggcttgggagcggctggagaaggcggagcacgagcgtgagctggccctgcgcaccgagctcatccgccaggagaagctggagcagctggccgcccgcttcgaccgcaaggctgccatgcgggagacctggctcagcgagaaccagcgcctcgtgtcccaggacaactttgggctggagctggcagctgtcgaggcagcagtacggaagcacgaagccattgagacggacatcgtggcctacagcggccgggtgcaggcagtggacgccgtggctgcagagctggccgccgagcgctaccacgacatcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaagggccggctgcagtctcaggacctgggcaggcacctagcaggagtggaggacctgctgcagctgcacgagctggtggaggcagacatcgccgtgcaggccgagagggtgcgggccgtcagcgcctctgccctgcgcttctgcaacccagggaaagagtatagaccttgcgacccgcagctggtgtcggagcgggtggccaagctagagcagagctatgaggcactgtgcgagttggcagcggcgcggcgggcccggctggaggaatcacggcggctctggcgtttcctctgggaggtgggtgaagctgaggcctgggtgcgggagcagcagcacctcctggcctcagccgacacgggccgagacctgaccggtgccctccgcctgctcaacaagcacacagccctgcggggcgagatgagcggccggctggggcccctgaagctcaccctggagcagggccagcagttggtggccgagggtcaccctggggcaagccaggcctctgcccgtgcagctgaactccaagcccagtgggagcggctagaggccctggccgaggagcgtgcccagcggctggcccaagccgccagcctctaccagttccaggccgatgcaaacgacatggaggcctggttggttgacgcactgcgcctggtgtccagccccgagctggggcacgacgagttctccacgcaggctctagccaggcagcatcgggccctggaggaggagattcgaagccaccggccaaccctggacgccttgagggaacaggcagcagccctgccccccacactgagccgcacgcccgaggtgcagagccgggtgcccaccctggagcggcactacgaggagctgcaggcccgggcaggcgagcgagcgcgggccttggaggcagccctggcgctctacaccatgctcagcgaggccggggcctgtggactctgggtggaggagaaggagcagtggctcaacgggctggccctgcctgaacgcctggaggacctggaggtcgtgcagcagaggttcgagaccctggagcctgaaatgaacacccttgcagcacaaatcaccgcggtgaatgacattgccgagcagttactgaaggccaaccccccaggcaaagaccgcattgtcaacacccaggagcagctcaaccacaggtggcagcagtttcggcgtctggcagacggcaagaaggcagctctcacctcagccctgagcatccagaactaccacttagagtgcacggagacccaggcctggatgagagagaagaccaaagtcatcgagtccacccagggcctaggcaacgatctggctggggtgctggccctgcagcgcaagctggccggcacggagcgggacctggaggccatcgccgcccgggtgggcgaactgactcgagaggcaaatgccctggctgccggccatcccgctcaggcagtggccatcaacgcccggctgagagaggtgcagaccggctgggaggacctcagggccaccatgcggcgtcgagaagagtcgctgggggaggcgcggcggctgcaggacttcttgcgcagcttggatgacttccaggcctggctaggccgcactcagactgctgtggcctctgaagaagggccggccaccctgcctgaggcagaggccctcctggcccaacatgcagccctgcggggagaggtggagcgggcccagagcgagtatagccggctgcgagccctgggcgaggaggtgacccgggaccaggctgacccccagtgcctcttcctacgacagcgactggaggccctgggaactggctgggaggagctgggccgaatgtgggagagccggcaaggtcgcctggcccaggcccacggcttccagggattcctgcgggatgctcgtcaggctgagggcgtgctcagcagccaggaatatgttctgtctcacacggagatgccagggacactccaggctgctgatgctgccattaaaaaactggaggacttcatgagcaccatggacgccaatggggaacggatccacgggctcctggaggctggccgccagctggtatctgaaggcaacatccacgccgacaagattcgggaaaaggcagactccattgagaggaggcacaagaagaatcaagacgcagcgcagcaatttctgggccgtcttcgggacaaccgggagcagcagcatttcctgcaagattgtcacgagctgaagctctggatcgacgagaagatgctgacagcccaggacgtgtcctatgacgaggcccgcaacctgcatactaagtggcagaagcaccaggcattcatggccgagctggctgccaacaaagactggctggacaaggtggacaaggaagggcgagagctcacccttgagaagccagagctgaaagccctggtgtcggagaagctgagagacctgcacaggcgctgggacgagctggagaccaccacccaagccaaggcccgcagcctctttgatgccaaccgagctgagctgtttgcccagagctgctgtgccctggagagctggctggagagcctgcaggcccagctgcactcggatgactacggcaaggacctcaccagcgtcaacatcctgctcaagaagcagcagatgctggaatgggagatggctgtgagagagaaggaggtggaggcaatccaggcccaggccaaagcactggcccaggaggaccagggtgcaggggaggtggagagaacctcgagggccgtggaggagaagttcagggccttgtgccagcccatgcgggaacgctgccggcgcctgcaggcttctcgcgagcagcaccagttccaccgcgatgtggaagatgagattttgtgggtgacagagcggctgcccatggccagctccatggagcatggcaaggacctgcccagcgtccagcttctcatgaagaaaaaccagaccctgcagaaagagattcagggccatgagccccggatcgcggacctgagggagcggcagcgtgctctaggtgcagcagcagcaggtccagagctggctgagctgcaggaaatgtggaaacgcctgggccacgagctggaacttcgagggaagcgactggaggatgccctgcgagcccagcagttctaccgcgatgccgccgaggcggaggcctggatgggcgagcaggaattacacatgatgggccaggagaaggccaaggatgagctgagtgcccaggcagaggtgaagaagcaccaggtgctggagcaagccctggccgactacgcgcagaccatccaccagctggcggccagcagccaggacatgattgaccacgagcacccagagagcactcggatatccatccgccaagcccaggtggacaagctgtatgccggcctgaaggagctggctggagagcggcgggagcgcctgcaggagcacctccggctgtgccagctccgccgcgagctggatgacctggaacagtggatccaggagcgcgaggtggtggcggcctcccacgagctgggccaggactacgagcatgtgactatgctccgagacaaattccgagagttctcccgggacacaagcaccatcggtcaggagcgcgtagatagcgccaatgcgctggccaatgggctcattgctgggggccatgctgcacgggccaccgtggccgagtggaaggacagtctcaacgaggcctgggctgacctgcttgagctgctggacacacggggtcaggtgctggccgcggcgtacgagctgcagcgcttcctgcacggggcacgccaagccctggcgcgggtgcagcacaagcagcagcagcttccggacgggactggccgcgacctcaacgctgccgaggccctgcagcgccgacactgtgcctacgagcatgacattcaggccctcagcccccaggtccagcaggtgcaggacgacggccaccggctccagaaggcctacgctggagacaaggctgaggagatcggccgccacatgcaggccgtggccgaggcctgggcccagcttcagggaagctctgccgcccgccggcagctgctgctggacaccacagacaagttccgcttcttcaaggctgtccgggaactgatgctctggatggatgaggtcaacctgcagatggatgcccaggagcgtccccgggatgtgtcctccgcggatctagtcatcaagaaccagcaaggcatcaaggcagagatagaggcccgggcagaccgcttctcctcctgcatcgacatggggaaggagctgctggccaggagccactatgcggccgaggagatctcagagaagctgtctcagctgcaggcacggcgccaggagacagctgagaagtggcaggagaagatggactggcttcagctggttttggaggtgcttgtgtttggaagagatgcagggatggcagaggcctggctctgcagccaggagccactggtgcgcagcgctgagctgggttgcacggtcgacgaagttgagagcctcatcaagcggcacgaggccttccagaagtcagcagtggcctgggaggagcgattctgtgcgctggagaagcttactgcgctagaggagcgggagaaggagcgaaagagaaagagggaggaggaggagcggcggaaacagccgcctgctcccgaacccacagccagtgtgcctccaggggacctggtgggcggccagacagcttctgacaccacctgggacggaacccagccacggccaccaccatccacacaagcacccagtgttaatggagtctgcacagatggagagccctcacagcccctgctgggacaacagagacttgagcacagcagcttccccgaagggccgggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctgggcttacaggatggaaaagaatatttattccaggccaaggatgaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggtaaccccctctcccacccccgccgacttctcccctttccccagcctcgtgcctctgtccctcaccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccacccccaccctgtaactccagctgccactccatctccagctgctctcaatggcttccaggtgtgttgttcggggacagccaccgccttgagtctggccaaggaggtgattaaacagctcagcttctctcac

SEQ ID NO: 29663 - DNA, 6567 bp, Homo sapiens
ggccgggccgggcagcggacgccgacagggagggcggtcggtcgcggcgagcagcggagacagcgacgctggcggccgcgggcccaggcctcaccttccccgatggcgcaggtaccaggggaagtggacaacatggagggcctgcctgctcctaacaacaaccctgctgcccgctgggagagtccggatcggggctgggagcgggagcagccggctgcgtccaccgcagcggcctcgctctttgagtgctcccggatcaaggccttggcagatgagcgggaagccgtgcagaagaaaaccttcaccaagtgggtgaactcgcacctcgcccgcgtgggctgccacatcggggacctctatgtggacctccgggacggcttcgtgctcacgcggctcctggaagtgctgtctggggagcagctgcccaggcccacgcgcggccgcatgcggatccactcactggagaacgtggacaaggcgctgcagtttctgaaggagcagcgcgtgcacctggagaacgtgggttcgcatgacatcgtggatgggaatcaccggctgacgctggggctggtctggaccatcatcctgcgcttccagattcaagtcatcaaaattgagactgaggacaacagagagacacgctcagccaaggatgctctgctcttgtggtgtcagatgaagacagctggttaccctgaggtaaacatccagaatttcaccaccagctggcgggatggcttggccttcaatgccctcattcaccggcacaggcctgatctcgtggacttcagcaaactcaccaagtccaatgccaactacaacctgcagagagccttccgcacagctgagcagcacctggggctggcgcggctgctggatcctgaagatgtgaacatggaggctccagatgagaagtccatcatcacctacgtggtctctttctaccactatttctccaagatgaaggctctggctgtggaggggaagcgtatcgggaaggtcttggaccaggtattggaggtggggaagatcatagaacgctacgaggagctggcggctgagctgctggcctggatccaccgcaccgtgggcctcatcagcaatcagaaatttgccaactccttaagtggggtgcagcagcaactccaggctttcacggcctattgcacgctggagaagcctgtcaagttccaggagaaggggaacctagaggtgctgctcttcagcatccagagcaaactgcgtgcctgcaaccgtcgcctctttgtgcctcgggagggctgtggcatctgggatattgacaaggcatggggtgagctggagaaggctgagcatgagcgggaggctgccctacgggctgagctgattcggcaggagaagctggaactactggcacagaggtttgaccacaaggtggctatgagggagagctggctgaatgagaaccagcgtctggtctcccaggacaactttgggtatgagctgcccgcagtggaggcagccatgaagaaacacgaagcgatcgaggcagacattgcggcctacgaggagcgggtgcagggtgtggcggagctggcccaggcattggcagccgaaggctactacgatatccggcgggtggcagcccagcgtgacagcgtcctgcgccagtgggccctgctaactgggcttgtgggtgcccggcggacacgacttgagcagaaccttgccctgcagaaggtcttccaggagatggtgtacatggtggactggatggaggagatgcaggctcagctgctgtcccgggagtgtgggcagcacctggtggaggcagacgacctgttgcagaagcatggactgctggagggagacattgccgcccagagcgagcgggtggaggctctcaatgccgctgccctgcgcttctcccagctgcagggctaccagccctgcgacccgcaggtcatctgcaaccgcgtgaaccacgtgcacggctgcctggcggagctgcaggagcaggcagcgcggcgacgcgcggagctggaggcttcgcggagcctgtgggcgctgctgcaggagctggaggaggccgagagctgggcgcgcgacaaggagcgtctcctggaggctgcgggcggcggcggtgcggcgggcgcagcgggcgcagcgggaacagcgggcggcgcgcatgacctgtccagcacagcgcgcctcctggcccagcacaagatcctgcagggcgagctgggcgggcggcgagcgttgctgcagcaggccctgcggtgtggcgaggagctggttgcggccggcggtgccgtcggcccgggagcagacaccgtgcacctggtaggcctggcggagcgcgcggcgagcgcccggcgccgctggcagaggctggaagaggcggcggcgcggcgagagcggcggctgcaggaggcgcgggcgctgcaccagttcggcgctgacctcgacgggctgctggactggcttcgcgacgcttaccgcctggcagccgccggtgacttcggccacgacgaagcttccagccgccgcctggcgcgccagcaccgcgcgctcaccggggaggtggaggcacatcgcgggcccgtgagcggcctgcggcgccagctggcgacactcgggggtgccagtggcgcagggccactggtggtggcgctgcaggtgcgcgtggtggaagcagagcagttgttcgctgaggtgaccgaagtggcggcgctgaggcgccagtggctgcgggacgcgctcgctgtctaccgcatgtttggcgaggtgcacgcgtgtgagctgtggatcggcgagaaggagcaatggctgctctccatgcgtgtgccggattcactcgacgacgtcgaggtggtgcagcaccgattcgagagcctggaccaagagatgaacagcctgatgggccgcgttctggacgtgaaccacacagtccaggagctggtggaaggaggccaccccagttcagatgaggtgcgttcctgccaggaccacctcaacagcaggtggaaccgcatcgtggagctagtggaacagcgcaaagaggaaatgagcgcggtgctgctggtggagaaccacgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggcagccctgctggctgagcgcttcccggcgcaggcggcgcggctgcaccagggcgcggaggagctgggcgccgagtggggcgcgctagctagcgcggctcaggcctgcggcgaggcggtggcggcagcagggcgcctgcagcgcttcctacatgacctcgacgctttcctggactggctcgtgcgcgcccaggaggcggcgggcggcagcgaggggcccctgcccaacagcctagaagaggcggacgcgctgctggcgcgccacgctgcgctcaaggaggaggtggaccagcgcgaggaagactatgctcgcatcgtggcggccagcgaggcgctgctggccgccgacggcgcagagctgggcccgggcctggcactagacgagtggctgccacacctcgaacttggctggcataaactgctcggcttgtgggaggcgcgcagggaggcgctggtccaggcgcacatctaccagctcttcctgcgggatctacgccaggcgctcgtggtgctgcgtaaccaggagatggcgctgtctggtgcggagctcccgggcacagtggaatcggtggaggaggccttgaaacagcaccgtgactttctcaccaccatggagctgagccagcaaaagatgcaggtggccgtgcaggctgcagagggcctgctgaggcagggcaacatctacggggagcaggctcaggaggctgtgacccggctgctggagaagaaccaagaaaaccagttacgggcccagcaatggatgcaaaagctacatgaccaacttgagctgcagcacttcctccgagactgccacgagctggatggctggatccatgagaagatgctgatggcgcgggatggcacgcgggaggacaaccacaagctgcataagagatggctccggcaccaggcattcatggccgagctggctcagaataaggagtggctggagaagatcgagcgggagggccagcaactgatgcaggagaagcccgaactggcggcctccgtgcggaagaagctgggcgagatccgccagtgctgggcggagctggagagcaccacccaggccaaggcacggcagctctttgaggccagcaaagcagaccagctggtgcagagctttgctgagctggacaagaagctccttcacatggagagccagctgcaagacgtggaccctggaggagacctggccactgtcaacagtcagctcaagaagctgcagtccatggagtcgcaggtggaggagtggtaccgcgaggtgggagagctgcaggcgcagacggcggcgctgccgctggagccggcgagcaaggagctggtgggtgagcggcagaacgcggtgggcgagcgcctggtgcgcctgctcgagccgttgcaggagcgccgccgcttgctgctggcttccaaggagttgcaccaggtggcgcacgacctggacgacgagctggcatgggttcaggagcggctgccactggccatgcagacagagcgaggcaacggtttgcaggcggtccagcagcacatcaaaaagaaccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggacgaacagagcaccctgcagctgctcaagaaacacctgcagctggagcaaggcgtggagaactacgaggaaagcatcgcgcagctgtcgcgccagtgccgggcgctgctggagatggggcacccggacagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactggattgccgagaaggaggtggtggctggctcacccgagctcggccaggactttgagcatgtctcggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtacggcagctgcaggagggggcggcccagctgcggacggtgtatgcgggtgaacatgccgaggccatcgctagccgggagcaggaggtgctgcagggttggaaagagctgctgtcagcctgtgaggatgcccgcctgcatgtcagctccacagccgacgccctgcgcttccacagccaagtccgcgacctgctctcctggatggatggcatcgccagccagattggggcagccgacaagcccagggacgtgtcatcagtggaggtgctcatgaactaccaccagggcctgaagactgagctggaggcgcgggtgcctgagctgaccacctgccaggagctggggcgatctctgctgctcaacaaaagtgccatggctgatgagatccaggcacagctggacaagctgggaaccaggaaggaggaggtgtcggaaaagtgggaccgccattgggagtggctgcagcagatgctggaggtgcaccagtttgcccaggaggcggtggtggctgatgcctggctgacagcccaggagccgctcctgcagagccgggagctgggcagcagcgtggatgaggtggagcagcttatccggcgacatgaggccttccgcaaagcggctgcagcctgggaagagaggttcagctctctgcggcgcctgaccacgcctaggcgggaggatcacttgaacccaggagttcaagaccagccttggcaacatactgagaagccgtctctaccaaaaccaaaagcaaacaaagaaaaaacagccaggcgtgatggcacgtgcctgtag

SEQ ID NO: 29664 - DNA, 4032 bp, Homo sapiens
ggccgggccgggcagcggacgccgacagggagggcggtcggtcgcggcgagcagcggagacagcgacgctggcggccgcgggcccaggcctcaccttccccgatggcgcaggtaccaggggaagtggacaacatggagggcctgcctgctcctaacaacaaccctgctgcccgctgggagagtccggatcggggctgggagcgggagcagccggctgcgtccaccgcagcggcctcgctctttgagtgctcccggatcaaggccttggcagatgagcgggaagccgtgcagaagaaaaccttcaccaagtgggtgaactcgcacctcgcccgcgtgggctgccacatcggggacctctatgtggacctccgggacggcttcgtgctcacgcggctcctggaagtgctgtctggggagcagctgcccaggcccacgcgcggccgcatgcggatccactcactggagaacgtggacaaggcgctgcagtttctgaaggagcagcgcgtgcacctggagaacgtgggttcgcatgacatcgtggatgggaatcaccggctgacgctggggctggtctggaccatcatcctgcgcttccagattcaagtcatcaaaattgagactgaggacaacagagagacacgctcagccaaggatgctctgctcttgtggtgtcagatgaagacagctggttaccctgaggtaaacatccagaatttcaccaccagctggcgggatggcttggccttcaatgccctcattcaccggcacaggcctgatctcgtggacttcagcaaactcaccaagtccaatgccaactacaacctgcagagagccttccgcacagctgagcagcacctggggctggcgcggctgctggatcctgaagatgtgaacatggaggctccagatgagaagtccatcatcacctacgtggtctctttctaccactatttctccaagatgaaggctctggctgtggaggggaagcgtatcgggaaggtcttggaccaggtattggaggtggggaagatcatagaacgctacgaggagctggcggctgagctgctggcctggatccaccgcaccgtgggcctcatcagcaatcagaaatttgccaactccttaagtggggtgcagcagcaactccaggctttcacggcctattgcacgctggagaagcctgtcaagttccaggagaaggggaacctagaggtgctgctcttcagcatccagagcaaactgcgtgcctgcaaccgtcgcctctttgtgcctcgggagggctgtggcatctgggatattgacaaggcatggggtgagctggagaaggctgagcatgagcgggaggctgccctacgggctgagctgattcggcaggagaagctggaactactggcacagaggtttgaccacaaggtggctatgagggagagctggctgaatgagaaccagcgtctggtctcccaggacaactttgggtatgagctgcccgcagtggaggcagccatgaagaaacacgaagcgatcgaggcagacattgcggcctacgaggagcgggtgcagggtgtggcggagctggcccaggcattggcagccgaaggctactacgatatccggcgggtggcagcccagcgtgacagcgtcctgcgccagtgggccctgctaactgggcttgtgggtgcccggcggacacgacttgagcagaaccttgccctgcagaaggtcttccaggagatggtgtacatggtggactggatggaggagatgcaggctcagctgctgtcccgggagtgtgggcagcacctggtggaggcagacgacctgttgcagaagcatggactgctggagggagacattgccgcccagagcgagcgggtggaggctctcaatgccgctgccctgcgcttctcccagctgcagggctaccagccctgcgacccgcaggtcatctgcaaccgcgtgaaccacgtgcacggctgcctggcggagctgcaggagcaggcagcgcggcgacgcgcggagctggaggcttcgcggagcctgtgggcgctgctgcaggagctggaggaggccgagagctgggcgcgcgacaaggagcgtctcctggaggctgcgggcggcggcggtgcggcgggcgcagcgggcgcagcgggaacagcgggcggcgcgcatgacctgtccagcacagcgcgcctcctggcccagcacaagatcctgcagggcgagctgggcgggcggcgagcgttgctgcagcaggccctgcggtgtggcgaggagctggttgcggccggcggtgccgtcggcccgggagcagacaccgtgcacctggtaggcctggcggagcgcgcggcgagcgcccggcgccgctggcagaggctggaagaggcggcggcgcggcgagagcggcggctgcaggaggcgcgggcgctgcaccagttcggcgctgacctcgacgggctgctggactggcttcgcgacgcttaccgcctggcagccgccggtgacttcggccacgacgaagcttccagccgccgcctggcgcgccagcaccgcgcgctcaccggggaggtggaggcacatcgcgggcccgtgagcggcctgcggcgccagctggcgacactcgggggtgccagtggcgcagggccactggtggtggcgctgcaggtgcgcgtggtggaagcagagcagttgttcgctgaggtgaccgaagtggcggcgctgaggcgccagtggctgcgggacgcgctcgctgtctaccgcatgtttggcgaggtgcacgcgtgtgagctgtggatcggcgagaaggagcaatggctgctctccatgcgtgtgccggattcactcgacgacgtcgaggtggtgcagcaccgattcgagagcctggaccaagagatgaacagcctgatgggccgcgttctggacgtgaaccacacagtccaggagctggtggaaggaggccaccccagttcagatgaggtgcgttcctgccaggaccacctcaacagcaggtggaaccgcatcgtggagctagtggaacagcgcaaagaggaaatgagcgcggtgctgctggtggagaaccacgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggcagccctgctggctgagcgcttcccggcgcaggcggcgcggctgcaccagggcgcggaggagctgggcgccgagtggggcgcgctagctagcgcggctcaggcctgcggcgaggcggtggcggcagcagggcgcctgcagcgcttcctacatgacctcgacgctttcctggactggctcgtgcgcgcccaggaggcggcgggcggcagcgaggggcccctgcccaacagcctagaagaggcggacgcgctgctggcgcgccacgctgcgctcaaggaggaggtggaccagcgcgaggaagactatgctcgcatcgtggcggccagcgaggcgctgctggccgccgacggcgcagagctgggcccgggcctggcactagacgagtggctgccacacctcgaacttggctggcataaactgctcggcttgtgggaggcgcgcagggaggcgctggtccaggcgcacatctaccagctcttcctgcgggatctacgccaggcgctcgtggtgctgcgtaaccaggagatggcgctgtctggtgcggagctcccgggcacagtggaatcggtggaggaggccttgaaacagcaccgtgactttctcaccaccatggagctgagccagcaaaagatgcaggtggccgtgcaggctgcagagggcctgctgaggcagggcaacatctacggggagcaggctcaggaggctgtgacccggctgctggagaaatgcctcattatccatcctgctcttctgcaccctccttgggaacccccagacctccccagatccagcagctag

SEQ ID NO: 29665 - DNA, 8686 bp, Homo sapiens
ggccgggccgggcagcggacgccgacagggagggcggtcggtcgcggcgagcagcggagacagcgacgctggcggccgcgggcccaggcctcaccttccccgatggcgcaggtaccaggggaagtggacaacatggagggcctgcctgctcctaacaacaaccctgctgcccgctgggagagtccggatcggggctgggagcgggagcagccggctgcgtccaccgcagcggcctcgctctttgagtgctcccggatcaaggccttggcagatgagcgggaagccgtgcagaagaaaaccttcaccaagtgggtgaactcgcacctcgcccgcgtgggctgccacatcggggacctctatgtggacctccgggacggcttcgtgctcacgcggctcctggaagtgctgtctggggagcagctgcccaggcccacgcgcggccgcatgcggatccactcactggagaacgtggacaaggcgctgcagtttctgaaggagcagcgcgtgcacctggagaacgtgggttcgcatgacatcgtggatgggaatcaccggctgacgctggggctggtctggaccatcatcctgcgcttccagattcaagtcatcaaaattgagactgaggacaacagagagacacgctcagccaaggatgctctgctcttgtggtgtcagatgaagacagctggttaccctgaggtaaacatccagaatttcaccaccagctggcgggatggcttggccttcaatgccctcattcaccggcacaggcctgatctcgtggacttcagcaaactcaccaagtccaatgccaactacaacctgcagagagccttccgcacagctgagcagcacctggggctggcgcggctgctggatcctgaagatgtgaacatggaggctccagatgagaagtccatcatcacctacgtggtctctttctaccactatttctccaagatgaaggctctggctgtggaggggaagcgtatcgggaaggtcttggaccaggtattggaggtggggaagatcatagaacgctacgaggagctggcggctgagctgctggcctggatccaccgcaccgtgggcctcatcagcaatcagaaatttgccaactccttaagtggggtgcagcagcaactccaggctttcacggcctattgcacgctggagaagcctgtcaagttccaggagaaggggaacctagaggtgctgctcttcagcatccagagcaaactgcgtgcctgcaaccgtcgcctctttgtgcctcgggagggctgtggcatctgggatattgacaaggcatggggtgagctggagaaggctgagcatgagcgggaggctgccctacgggctgagctgattcggcaggagaagctggaactactggcacagaggtttgaccacaaggtggctatgagggagagctggctgaatgagaaccagcgtctggtctcccaggacaactttgggtatgagctgcccgcagtggaggcagccatgaagaaacacgaagcgatcgaggcagacattgcggcctacgaggagcgggtgcagggtgtggcggagctggcccaggcattggcagccgaaggctactacgatatccggcgggtggcagcccagcgtgacagcgtcctgcgccagtgggccctgctaactgggcttgtgggtgcccggcggacacgacttgagcagaaccttgccctgcagaaggtcttccaggagatggtgtacatggtggactggatggaggagatgcaggctcagctgctgtcccgggagtgtgggcagcacctggtggaggcagacgacctgttgcagaagcatggactgctggagggagacattgccgcccagagcgagcgggtggaggctctcaatgccgctgccctgcgcttctcccagctgcagggctaccagccctgcgacccgcaggtcatctgcaaccgcgtgaaccacgtgcacggctgcctggcggagctgcaggagcaggcagcgcggcgacgcgcggagctggaggcttcgcggagcctgtgggcgctgctgcaggagctggaggaggccgagagctgggcgcgcgacaaggagcgtctcctggaggctgcgggcggcggcggtgcggcgggcgcagcgggcgcagcgggaacagcgggcggcgcgcatgacctgtccagcacagcgcgcctcctggcccagcacaagatcctgcagggcgagctgggcgggcggcgagcgttgctgcagcaggccctgcggtgtggcgaggagctggttgcggccggcggtgccgtcggcccgggagcagacaccgtgcacctggtaggcctggcggagcgcgcggcgagcgcccggcgccgctggcagaggctggaagaggcggcggcgcggcgagagcggcggctgcaggaggcgcgggcgctgcaccagttcggcgctgacctcgacgggctgctggactggcttcgcgacgcttaccgcctggcagccgccggtgacttcggccacgacgaagcttccagccgccgcctggcgcgccagcaccgcgcgctcaccggggaggtggaggcacatcgcgggcccgtgagcggcctgcggcgccagctggcgacactcgggggtgccagtggcgcagggccactggtggtggcgctgcaggtgcgcgtggtggaagcagagcagttgttcgctgaggtgaccgaagtggcggcgctgaggcgccagtggctgcgggacgcgctcgctgtctaccgcatgtttggcgaggtgcacgcgtgtgagctgtggatcggcgagaaggagcaatggctgctctccatgcgtgtgccggattcactcgacgacgtcgaggtggtgcagcaccgattcgagagcctggaccaagagatgaacagcctgatgggccgcgttctggacgtgaaccacacagtccaggagctggtggaaggaggccaccccagttcagatgaggtgcgttcctgccaggaccacctcaacagcaggtggaaccgcatcgtggagctagtggaacagcgcaaagaggaaatgagcgcggtgctgctggtggagaaccacgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggcagccctgctggctgagcgcttcccggcgcaggcggcgcggctgcaccagggcgcggaggagctgggcgccgagtggggcgcgctagctagcgcggctcaggcctgcggcgaggcggtggcggcagcagggcgcctgcagcgcttcctacatgacctcgacgctttcctggactggctcgtgcgcgcccaggaggcggcgggcggcagcgaggggcccctgcccaacagcctagaagaggcggacgcgctgctggcgcgccacgctgcgctcaaggaggaggtggaccagcgcgaggaagactatgctcgcatcgtggcggccagcgaggcgctgctggccgccgacggcgcagagctgggcccgggcctggcactagacgagtggctgccacacctcgaacttggctggcataaactgctcggcttgtgggaggcgcgcagggaggcgctggtccaggcgcacatctaccagctcttcctgcgggatctacgccaggcgctcgtggtgctgcgtaaccaggagatggcgctgtctggtgcggagctcccgggcacagtggaatcggtggaggaggccttgaaacagcaccgtgactttctcaccaccatggagctgagccagcaaaagatgcaggtggccgtgcaggctgcagagggcctgctgaggcagggcaacatctacggggagcaggctcaggaggctgtgacccggctgctggagaagaaccaagaaaaccagttacgggcccagcaatggatgcaaaagctacatgaccaacttgagctgcagcacttcctccgagactgccacgagctggatggctggatccatgagaagatgctgatggcgcgggatggcacgcgggaggacaaccacaagctgcataagagatggctccggcaccaggcattcatggccgagctggctcagaataaggagtggctggagaagatcgagcgggagggccagcaactgatgcaggagaagcccgaactggcggcctccgtgcggaagaagctgggcgagatccgccagtgctgggcggagctggagagcaccacccaggccaaggcacggcagctctttgaggccagcaaagcagaccagctggtgcagagctttgctgagctggacaagaagctccttcacatggagagccagctgcaagacgtggaccctggaggagacctggccactgtcaacagtcagctcaagaagctgcagtccatggagtcgcaggtggaggagtggtaccgcgaggtgggagagctgcaggcgcagacggcggcgctgccgctggagccggcgagcaaggagctggtgggtgagcggcagaacgcggtgggcgagcgcctggtgcgcctgctcgagccgttgcaggagcgccgccgcttgctgctggcttccaaggagttgcaccaggtggcgcacgacctggacgacgagctggcatgggttcaggagcggctgccactggccatgcagacagagcgaggcaacggtttgcaggcggtccagcagcacatcaaaaagaaccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggacgaacagagcaccctgcagctgctcaagaaacacctgcagctggagcaaggcgtggagaactacgaggaaagcatcgcgcagctgtcgcgccagtgccgggcgctgctggagatggggcacccggacagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactggattgccgagaaggaggtggtggctggctcacccgagctcggccaggactttgagcatgtctcggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtacggcagctgcaggagggggcggcccagctgcggacggtgtatgcgggtgaacatgccgaggccatcgctagccgggagcaggaggtgctgcagggttggaaagagctgctgtcagcctgtgaggatgcccgcctgcatgtcagctccacagccgacgccctgcgcttccacagccaagtccgcgacctgctctcctggatggatggcatcgccagccagattggggcagccgacaagcccagggacgtgtcatcagtggaggtgctcatgaactaccaccagggcctgaagactgagctggaggcgcgggtgcctgagctgaccacctgccaggagctggggcgatctctgctgctcaacaaaagtgccatggctgatgagatccaggcacagctggacaagctgggaaccaggaaggaggaggtgtcggaaaagtgggaccgccattgggagtggctgcagcagatgctggaggtgcaccagtttgcccaggaggcggtggtggctgatgcctggctgacagcccaggagccgctcctgcagagccgggagctgggcagcagcgtggatgaggtggagcagcttatccggcgacatgaggccttccgcaaagcggctgcagcctgggaagagaggttcagctctctgcggcgcctgaccacgatcgagaaaatcaaagcggaacagagcaagcagccgcctaccccactgctggggcgcaagttctttggggaccccacggaactggcggccaaggcggcgcccctgctgcggccagggggctatgaaaggggcttggagcccctggcccgccgagcctcggacacgctctcggccgaggtgcggactcgggtggggtatgtgcgccaggagctcaagcccgagcgcctccagccgcgcattgaccggctgccggagatcccggggagggtggagcccgcggccctgccggccgcaccagaggacgcggcggagacccccgcgacccccgcggcggcggagcaggtgcggccacgaccggagcgccaggagtcagctgatcgcgcggaggagctgcccaggaggcggcggcctgagcggcaagagtcagtcgatcaatccgaggaggctgcgcggaggcggcggccggagcggcaggagtcagcggagcacgaggcggcacacagccttaccctgggccgctatgagcagatggagcggcggcgcgagcggcgtgagcggcgcttggagcggcaggagtccagcgaacaggagatgcccatcagaggagacctggtcaaggggaaggccaccctggctgacattgtggaacagctgcaggagaaagaggcaggcccagggctgcctgctgggccgtcgctgcctcagccacgcgagcttcccccaggtcgcctgcccaacgggcttgagctgcccgagcggacacctcggccggaccggccccgggcgcgggaccggcccaagccgcgacggcggccgcggcccagagagggtggtgagggcgggggaagccggcgctcgcgctccgccccggcccagggcggctccgcccccgcgcctccgccaccgcccactcacacagtgcagcacgagggcttcctactgcgcaagcgcgagctcgacgctaaccgcaagtcgtccaaccggtcgtgggtgagcctgtactgtgtgcttagtaagggggaactgggcttctacaaggactccaagggcccggcatccgggagcacacacggtggggaaccgctgctcagcctgcacaaggccaccagcgaggtggctagtgactacaagaaaaagaagcatgtcttcaagctccagacccaggatggcagtgagtttttgctccaggcaaaagatgaggaggagatgaacggctggctggaggctgtagcttcctcggtggcggaacacgcagagatcgcccgctggggccagacactacccactacttcatccacagatgagggcaaccctaagagggaaggcggagatcgcagggccagcgggcgcaggaagtgacttcccacccccaggacctgacacatctcgtctcccctcttttccgcactgtgggcacaaagacactttttcttccgcaggggcgggagcccctagttccaacactgaggacgcgtgacatggtgggcaccggaaaggaggggacttctcctgcaccccaagaagtggtggggagattgctgcccctatagccatatctcggccccttcccactcaccacccccaccccaggtgctgggggtcccttatttttatgcaataactgagcttgatgggggtgggcagggggccagttgagccaagcccccagccccgatctgcagatcctgccccaagaagctggggtggtgggggcagtaattcctgcccccctctctgccctagggatgggcacgggggcgctggtgaggtcccctggaccatccagggtgctagggggcagggaggggacaccccctccccgcctttacctcacttccaatgctgccttgatctctgtctgggaggggggagtgaaggggccctagccccctgcactccgccgcctcagagccatgcggttaattcctgacttagtttatttttgcaaaacgtcgatctcctcctcccccgccccgcatccgcgaaggcttttaatgggaggggcgtcaaagctcaaaactgttttcctctctcctcccccctccagttgtaaatgccacttcatgaggggaggggcgaggggaagcccacccctgcatgcttctggctggagcacctccctggggagtcgggggattgggttgtgggcagtccccatggccgcctggagaagccgctggggcccgggggtgtggggcggtgtggcgggcgcacactgtatgtacctataataaaccctttggctttg

SEQ ID NO: 29666 - DNA, 2419 bp, Homo sapiens
ggagcctcagccttcgccgccgctgccgctgccgtcgcagttgaggggcgagcacccgcccgcccgctgcagggacgccccgccaacgccactgccgcttcagctggatggctggatccatgagaagatgctgatggcgcgggatggcacgcgggaggacaaccacaagctgcataagagatggctccggcaccaggcattcatggccgagctggctcagaataaggagtggctggagaagatcgagcgggagggccagcaactgatgcaggagaagcccgaactggcggcctccgtgcggaagaagctgggcgagatccgccagtgctgggcggagctggagagcaccacccaggccaaggcacggcagctctttgaggccagcaaagcagaccagctggtgcagagctttgctgagctggacaagaagctccttcacatggagagccagctgcaagacgtggaccctggaggagacctggccactgtcaacagtcagctcaagaagctgcagtccatggagtcgcaggtggaggagtggtaccgcgaggtgggagagctgcaggcgcagacggcggcgctgccgctggagccggcgagcaaggagctggtgggtgagcggcagaacgcggtgggcgagcgcctggtgcgcctgctcgagccgttgcaggagcgccgccgcttgctgctggcttccaaggagttgcaccaggtggcgcacgacctggacgacgagctggcatgggttcaggagcggctgccactggccatgcagacagagcgaggcaacggtttgcaggcggtccagcagcacatcaaaaagaaccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggacgaacagagcaccctgcagctgctcaagaaacacctgcagctggagcaaggcgtggagaactacgaggaaagcatcgcgcagctgtcgcgccagtgccgggcgctgctggagatggggcacccggacagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactggattgccgagaaggaggtggtggctggctcacccgagctcggccaggactttgagcatgtctcggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtacggcagctgcaggagggggcggcccagctgcggacggtgtatgcgggtgaacatgccgaggccatcgctagccgggagcaggaggtgctgcagggttggaaagagctgctgtcagcctgtgaggatgcccgcctgcatgtcagctccacagccgacgccctgcgcttccacagccaagtccgcgacctgctctcctggatggatggcatcgccagccagattggggcagccgacaagcccaggtgcccctcatccctcctcgggcttcctgcctccccctggtggcctaccccagccacccccagcccattgacagcccccttctcaatggaatgacaacagccaatatctgtgtggcgcctctgtgtgctaggcactgttctaggtgcttcgtgtgtattcagaccccttttttaggcctgtcattggggacttcggtcatggggcatccttctgtccgctgtccttcccagttgcctattattaccctctccatgggatgtcacagcatgaaacaggctaaagacaggatgggcaagggaggtgtgggactgtatttgtgagggtgggtgaagaattctaacaattcca

SEQ ID NO: 29667 - DNA, 4813 bp, Homo sapiens
atgcctcattatccatcctgctcttctgcaccctccttgggaacccccagacctccccagatccagcagctagaggccaggcacaggaaccaagaaaaccagttacgggcccagcaatggatgcaaaagctacatgaccaacttgagctgcagcacttcctccgagactgccacgagctggatggctggatccatgagaagatgctgatggcgcgggatggcacgcgggaggacaaccacaagctgcataagagatggctccggcaccaggcattcatggccgagctggctcagaataaggagtggctggagaagatcgagcgggagggccagcaactgatgcaggagaagcccgaactggcggcctccgtgcggaagaagctgggcgagatccgccagtgctgggcggagctggagagcaccacccaggccaaggcacggcagctctttgaggccagcaaagcagaccagctggtgcagagctttgctgagctggacaagaagctccttcacatggagagccagctgcaagacgtggaccctggaggagacctggccactgtcaacagtcagctcaagaagctgcagtccatggagtcgcaggtggaggagtggtaccgcgaggtgggagagctgcaggcgcagacggcggcgctgccgctggagccggcgagcaaggagctggtgggtgagcggcagaacgcggtgggcgagcgcctggtgcgcctgctcgagccgttgcaggagcgccgccgcttgctgctggcttccaaggagttgcaccaggtggcgcacgacctggacgacgagctggcatgggttcaggagcggctgccactggccatgcagacagagcgaggcaacggtttgcaggcggtccagcagcacatcaaaaagaaccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggacgaacagagcaccctgcagctgctcaagaaacacctgcagctggagcaaggcgtggagaactacgaggaaagcatcgcgcagctgtcgcgccagtgccgggcgctgctggagatggggcacccggacagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactggattgccgagaaggaggtggtggctggctcacccgagctcggccaggactttgagcatgtctcggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtacggcagctgcaggagggggcggcccagctgcggacggtgtatgcgggtgaacatgccgaggccatcgctagccgggagcaggaggtgctgcagggttggaaagagctgctgtcagcctgtgaggatgcccgcctgcatgtcagctccacagccgacgccctgcgcttccacagccaagtccgcgacctgctctcctggatggatggcatcgccagccagattggggcagccgacaagcccagggacgtgtcatcagtggaggtgctcatgaactaccaccagggcctgaagactgagctggaggcgcgggtgcctgagctgaccacctgccaggagctggggcgatctctgctgctcaacaaaagtgccatggctgatgagatccaggcacagctggacaagctgggaaccaggaaggaggaggtgtcggaaaagtgggaccgccattgggagtggctgcagcagatgctggaggtgcaccagtttgcccaggaggcggtggtggctgatgcctggctgacagcccaggagccgctcctgcagagccgggagctgggcagcagcgtggatgaggtggagcagcttatccggcgacatgaggccttccgcaaagcggctgcagcctgggaagagaggttcagctctctgcggcgcctgaccacgatcgagaaaatcaaagcggaacagagcaagcagccgcctaccccactgctggggcgcaagttctttggggaccccacggaactggcggccaaggcggcgcccctgctgcggccagggggctatgaaaggggcttggagcccctggcccgccgagcctcggacacgctctcggccgaggtgcggactcgggtggggtatgtgcgccaggagctcaagcccgagcgcctccagccgcgcattgaccggctgccggagatcccggggagggtggagcccgcggccctgccggccgcaccagaggacgcggcggagacccccgcgacccccgcggcggcggagcaggtgcggccacgaccggagcgccaggagtcagctgatcgcgcggaggagctgcccaggaggcggcggcctgagcggcaagagtcagtcgatcaatccgaggaggctgcgcggaggcggcggccggagcggcaggagtcagcggagcacgaggcggcacacagccttaccctgggccgctatgagcagatggagcggcggcgcgagcggcgtgagcggcgcttggagcggcaggagtccagcgaacaggagatgcccatcagaggagacctggtcaaggggaaggccaccctggctgacattgtggaacagctgcaggagaaagaggcaggcccagggctgcctgctgggccgtcgctgcctcagccacgcgagcttcccccaggtcgcctgcccaacgggcttgagctgcccgagcggacacctcggccggaccggccccgggcgcgggaccggcccaagccgcgacggcggccgcggcccagagagggtggtgagggcgggggaagccggcgctcgcgctccgccccggcccagggcggctccgcccccgcgcctccgccaccgcccactcacacagtgcagcacgagggcttcctactgcgcaagcgcgagctcgacgctaaccgcaagtcgtccaaccggtcgtgggtgagcctgtactgtgtgcttagtaagggggaactgggcttctacaaggactccaagggcccggcatccgggagcacacacggtggggaaccgctgctcagcctgcacaaggccaccagcgaggtggctagtgactacaagaaaaagaagcatgtcttcaagctccagacccaggatggcagtgagtttttgctccaggcaaaagatgaggaggagatgaacggctggctggaggctgtagcttcctcggtggcggaacacgcagagatcgcccgctggggccagacactacccactacttcatccacagatgagggcaaccctaagagggaaggcggagatcgcagggccagcgggcgcaggaagtgacttcccacccccaggacctgacacatctcgtctcccctcttttccgcactgtgggcacaaagacactttttcttccgcaggggcgggagcccctagttccaacactgaggacgcgtgacatggtgggcaccggaaaggaggggacttctcctgcaccccaagaagtggtggggagattgctgcccctatagccatatctcggccccttcccactcaccacccccaccccaggtgctgggggtcccttatttttatgcaataactgagcttgatgggggtgggcagggggccagttgagccaagcccccagccccgatctgcagatcctgccccaagaagctggggtggtgggggcagtaattcctgcccccctctctgccctagggatgggcacgggggcgctggtgaggtcccctggaccatccagggtgctagggggcagggaggggacaccccctccccgcctttacctcacttccaatgctgccttgatctctgtctgggaggggggagtgaaggggccctagccccctgcactccgccgcctcagagccatgcggttaattcctgacttagtttatttttgcaaaacgtcgatctcctcctcccccgccccgcatccgcgaaggcttttaatgggaggggcgtcaaagctcaaaactgttttcctctctcctcccccctccagttgtaaatgccacttcatgaggggaggggcgaggggaagcccacccctgcatgcttctggctggagcacctccctggggagtcgggggattgggttgtgggcagtccccatggccgcctggagaagccgctggggcccgggggtgtggggcggtgtggcgggcgcacactgtatgtacctataataaaccctttggctttg

SEQ ID NO: 29668 - DNA, 8671 bp, Homo sapiens
tatgaccctgtgtgactcagtgacccggagggcaagcaggactgtgggtgacaccttgtgtcatcctctgagcctcaccttccccgatggcgcaggtaccaggggaagtggacaacatggagggcctgcctgctcctaacaacaaccctgctgcccgctgggagagtccggatcggggctgggagcgggagcagccggctgcgtccaccgcagcggcctcgctctttgagtgctcccggatcaaggccttggcagatgagcgggaagccgtgcagaagaaaaccttcaccaagtgggtgaactcgcacctcgcccgcgtgggctgccacatcggggacctctatgtggacctccgggacggcttcgtgctcacgcggctcctggaagtgctgtctggggagcagctgcccaggcccacgcgcggccgcatgcggatccactcactggagaacgtggacaaggcgctgcagtttctgaaggagcagcgcgtgcacctggagaacgtgggttcgcatgacatcgtggatgggaatcaccggctgacgctggggctggtctggaccatcatcctgcgcttccagattcaagtcatcaaaattgagactgaggacaacagagagacacgctcagccaaggatgctctgctcttgtggtgtcagatgaagacagctggttaccctgaggtaaacatccagaatttcaccaccagctggcgggatggcttggccttcaatgccctcattcaccggcacaggcctgatctcgtggacttcagcaaactcaccaagtccaatgccaactacaacctgcagagagccttccgcacagctgagcagcacctggggctggcgcggctgctggatcctgaagatgtgaacatggaggctccagatgagaagtccatcatcacctacgtggtctctttctaccactatttctccaagatgaaggctctggctgtggaggggaagcgtatcgggaaggtcttggaccaggtattggaggtggggaagatcatagaacgctacgaggagctggcggctgagctgctggcctggatccaccgcaccgtgggcctcatcagcaatcagaaatttgccaactccttaagtggggtgcagcagcaactccaggctttcacggcctattgcacgctggagaagcctgtcaagttccaggagaaggggaacctagaggtgctgctcttcagcatccagagcaaactgcgtgcctgcaaccgtcgcctctttgtgcctcgggagggctgtggcatctgggatattgacaaggcatggggtgagctggagaaggctgagcatgagcgggaggctgccctacgggctgagctgattcggcaggagaagctggaactactggcacagaggtttgaccacaaggtggctatgagggagagctggctgaatgagaaccagcgtctggtctcccaggacaactttgggtatgagctgcccgcagtggaggcagccatgaagaaacacgaagcgatcgaggcagacattgcggcctacgaggagcgggtgcagggtgtggcggagctggcccaggcattggcagccgaaggctactacgatatccggcgggtggcagcccagcgtgacagcgtcctgcgccagtgggccctgctaactgggcttgtgggtgcccggcggacacgacttgagcagaaccttgccctgcagaaggtcttccaggagatggtgtacatggtggactggatggaggagatgcaggctcagctgctgtcccgggagtgtgggcagcacctggtggaggcagacgacctgttgcagaagcatggactgctggagggagacattgccgcccagagcgagcgggtggaggctctcaatgccgctgccctgcgcttctcccagctgcagggctaccagccctgcgacccgcaggtcatctgcaaccgcgtgaaccacgtgcacggctgcctggcggagctgcaggagcaggcagcgcggcgacgcgcggagctggaggcttcgcggagcctgtgggcgctgctgcaggagctggaggaggccgagagctgggcgcgcgacaaggagcgtctcctggaggctgcgggcggcggcggtgcggcgggcgcagcgggcgcagcgggaacagcgggcggcgcgcatgacctgtccagcacagcgcgcctcctggcccagcacaagatcctgcagggcgagctgggcgggcggcgagcgttgctgcagcaggccctgcggtgtggcgaggagctggttgcggccggcggtgccgtcggcccgggagcagacaccgtgcacctggtaggcctggcggagcgcgcggcgagcgcccggcgccgctggcagaggctggaagaggcggcggcgcggcgagagcggcggctgcaggaggcgcgggcgctgcaccagttcggcgctgacctcgacgggctgctggactggcttcgcgacgcttaccgcctggcagccgccggtgacttcggccacgacgaagcttccagccgccgcctggcgcgccagcaccgcgcgctcaccggggaggtggaggcacatcgcgggcccgtgagcggcctgcggcgccagctggcgacactcgggggtgccagtggcgcagggccactggtggtggcgctgcaggtgcgcgtggtggaagcagagcagttgttcgctgaggtgaccgaagtggcggcgctgaggcgccagtggctgcgggacgcgctcgctgtctaccgcatgtttggcgaggtgcacgcgtgtgagctgtggatcggcgagaaggagcaatggctgctctccatgcgtgtgccggattcactcgacgacgtcgaggtggtgcagcaccgattcgagagcctggaccaagagatgaacagcctgatgggccgcgttctggacgtgaaccacacagtccaggagctggtggaaggaggccaccccagttcagatgaggtgcgttcctgccaggaccacctcaacagcaggtggaaccgcatcgtggagctagtggaacagcgcaaagaggaaatgagcgcggtgctgctggtggagaaccacgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggcagccctgctggctgagcgcttcccggcgcaggcggcgcggctgcaccagggcgcggaggagctgggcgccgagtggggcgcgctagctagcgcggctcaggcctgcggcgaggcggtggcggcagcagggcgcctgcagcgcttcctacatgacctcgacgctttcctggactggctcgtgcgcgcccaggaggcggcgggcggcagcgaggggcccctgcccaacagcctagaagaggcggacgcgctgctggcgcgccacgctgcgctcaaggaggaggtggaccagcgcgaggaagactatgctcgcatcgtggcggccagcgaggcgctgctggccgccgacggcgcagagctgggcccgggcctggcactagacgagtggctgccacacctcgaacttggctggcataaactgctcggcttgtgggaggcgcgcagggaggcgctggtccaggcgcacatctaccagctcttcctgcgggatctacgccaggcgctcgtggtgctgcgtaaccaggagatggcgctgtctggtgcggagctcccgggcacagtggaatcggtggaggaggccttgaaacagcaccgtgactttctcaccaccatggagctgagccagcaaaagatgcaggtggccgtgcaggctgcagagggcctgctgaggcagggcaacatctacggggagcaggctcaggaggctgtgacccggctgctggagaagaaccaagaaaaccagttacgggcccagcaatggatgcaaaagctacatgaccaacttgagctgcagcacttcctccgagactgccacgagctggatggctggatccatgagaagatgctgatggcgcgggatggcacgcgggaggacaaccacaagctgcataagagatggctccggcaccaggcattcatggccgagctggctcagaataaggagtggctggagaagatcgagcgggagggccagcaactgatgcaggagaagcccgaactggcggcctccgtgcggaagaagctgggcgagatccgccagtgctgggcggagctggagagcaccacccaggccaaggcacggcagctctttgaggccagcaaagcagaccagctggtgcagagctttgctgagctggacaagaagctccttcacatggagagccagctgcaagacgtggaccctggaggagacctggccactgtcaacagtcagctcaagaagctgcagtccatggagtcgcaggtggaggagtggtaccgcgaggtgggagagctgcaggcgcagacggcggcgctgccgctggagccggcgagcaaggagctggtgggtgagcggcagaacgcggtgggcgagcgcctggtgcgcctgctcgagccgttgcaggagcgccgccgcttgctgctggcttccaaggagttgcaccaggtggcgcacgactggacgacgagctgggcatgggttcaggagcggctgccactggccatgcagacagagcgaggcaacggtttgcaggcggtccagcagcacatcaaaaagaaccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggacgaacagagcaccctgcagctgctcaagaaacacctgcagctggagcaaggcgtggagaactacgaggaaagcatcgcgcagctgtcgcgccagtgccgggcgctgctggagatggggcacccggacagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactggattgccgagaaggaggtggtggctggctcacccgagctcggccaggactttgagcatgtctcggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtacggcagctgcaggagggggcggcccagctgcggacggtgtatgcgggtgaacatgccgaggccatcgctagccgggagcaggaggtgctgcagggttggaaagagctgctgtcagcctgtgaggatgcccgcctgcatgtcagctccacagccgacgccctgcgcttccacagccaagtccgcgacctgctctcctggatggatggcatcgccagccagattggggcagccgacaagcccagggacgtgtcatcagtggaggtgctcatgaactaccaccagggcctgaagactgagctggaggcgcgggtgcctgagctgaccacctgccaggagctggggcgatctctgctgctcaacaaaagtgccatggctgatgagatccaggcacagctggacaagctgggaaccaggaaggaggaggtgtcggaaaagtgggaccgccattgggagtggctgcagcagatgctggaggtgcaccagtttgcccaggaggcggtggtggctgatgcctggctgacagcccaggagccgctcctgcagagccgggagctgggcagcagcgtggatgaggtggagcagcttatccggcgacatgaggccttccgcaaagcggctgcagcctgggaagagaggttcagctctctgcggcgcctgaccacgatcgagaaaatcaaagcggaacagagcaagcagccgcctaccccactgctggggcgcaagttctttggggaccccacggaactggcggccaaggcggcgcccctgctgcggccagggggctatgaaaggggcttggagcccctggcccgccgagcctcggacacgctctcggccgaggtgcggactcgggtggggtatgtgcgccaggagctcaagcccgagcgcctccagccgcgcattgaccggctgccggagatcccggggagggtggagcccgcggccctgccggccgcaccagaggacgcggcggagacccccgcgacccccgcggcggcggagcaggtgcggccacgaccggagcgccaggagtcagctgatcgcgcggaggagctgcccaggaggcggcggcctgagcggcaagagtcagtcgatcaatccgaggaggctgcgcggaggcggcggccggagcggcaggagtcagcggagcacgaggcggcacacagccttaccctgggccgctatgagcagatggagcggcggcgcgagcggcgtgagcggcgcttggagcggcaggagtccagcgaacaggagatgcccatcagaggagacctggtcaaggggaaggccaccctggctgacattgtggaacagctgcaggagaaagaggcaggcccagggctgcctgctgggccgtcgctgcctcagccacgcgagcttcccccaggtcgcctgcccaacgggcttgagctgcccgagcggacacctcggccggaccggccccgggcgcgggaccggcccaagccgcgacggcggccgcggcccagagagggtggtgagggcgggggaagccggcgctcgcgctccgccccggcccagggcggctccgcccccgcgcctccgccaccgcccactcacacagtgcagcacgagggcttcctactgcgcaagcgcgagctcgacgctaaccgcaagtcgtccaaccggtcgtgggtgagcctgtactgtgtgcttagtaagggggaactgggcttctacaaggactccaagggcccggcatccgggagcacacacggtggggaaccgctgctcagcctgcacaaggccaccagcgaggtggctagtgactacaagaaaaagaagcatgtcttcaagctccagacccaggatggcagtgagtttttgctccaggcaaaagatgaggaggagatgaacggctggctggaggctgtagcttcctcggtggcggaacacgcagagatcgcccgctggggccagacactacccactacttcatccacagatgagggcaaccctaagagggaaggcggagatcgcagggccagcgggcgcaggaagtgacttcccacccccaggacctgacacatctcgtctcccctcttttccgcactgtgggcacaaagacactttttcttccgcaggggcgggagcccctagttccaacactgaggacgcgtgacatggtgggcaccggaaaggaggggacttctcctgcaccccaagaagtggtggggagattgctgcccctatagccatatctcggccccttcccactcaccacccccaccccaggtgctgggggtcccttatttttatgcaataactgagcttgatgggggtgggcagggggccagttgagccaagcccccagccccgatctgcagatcctgccccaagaagctggggtggtgggggcagtaattcctgcccccctctctgccctagggatgggcacgggggcgctggtgaggtcccctggaccatccagggtgctagggggcagggaggggacaccccctccccgcctttacctcacttccaatgctgccttgatctctgtctgggaggggggagtgaaggggccctagccccctgcactccgccgcctcagagccatgcggttaattcctgacttagtttatttttgcaaaacgtcgatctcctcctcccccgccccgcatccgcgaaggcttttaatgggaggggcgtcaaagctcaaaactgttttcctctctcctcccccctccagttgtaaatgccacttcatgaggggaggggcgaggggaagcccacccctgcatgcttctggctggagcacctccctggggagtcgggggattgggttgtgggcagtccccatggccgcctggagaagccgctggggcccgggggtgtggggcggtgtggcgggcgcacactgtatgtacctataataaaccctttggctttga

SEQ ID NO: 29669 - DNA, 11722 bp, Homo sapiens
ggacaatgccgcctgtgtgccgtcaccccagcacgctggctcaaggggagggctgtggtgcagccctgctccagccttggcctctcctgatgtccctctccctccctccacagcccctgctatctgccatctccatccgtccagctgggccgcctctgtggaacccaggcatcaccaaggtttagggagccatccagcagctcctcatccccaaagtctgcagggctgatggctggtcagccccacagtccccgggagctcctcggggctgcagggcaccgcagcaggaggcccagcacagaactccgggtcccgcccagtccaagtctcaccatggactctcagtacgagacgggccacattcgcaagctacaggcccggcacatgcagatgcaggagaagactttcaccaagtggatcaataacgtcttccagtgcggccaggcgggcatcaagatccggaacctgtacacagagctggctgacggcatccacctcctgcggctgctggagctcatctcaggggaggccctgccacccccgagccggggccgcctgcgtgtgcacttcctggagaacagcagccgagctctggccttcctcagggccaaggtgccagtaccactcatcgggccagagaacatcgtggacggagaccagacactcatcctgggactcatctgggtcatcattctgcgtttccagatctcccacatctccttggacaaggaggagtttggggccagcgcagccctgctgtccaccaaggaagccctgctggtctggtgccagcggaagacagccagctacaccaacgtgaacattacagatttctcccgaagctggagcgatgggctgggcttcaatgccctcatccatgcccacaggccagacctgttggactacggctccctgcgtccagaccgcccactgcacaaccttgcttttgctttcctggtggctgagcaggagctgggcattgctcagctgctggaccccgaggacgtggcagccgcacagccagatgagcgctctatcatgacctacgtctccctctactaccactactgctcccgcctgcatcaggggcagactgtccagaggagactcactaagatcctgcttcagctccaggagacagagctgctgcagacccagtacgagcagctggtggctgaccttctacgctggattgcagagaagcagatgcagctggaggcgcgggattttccagactcgctgcccgccatgcggcagctactggcagcattcaccatcttccgcacccaggagaagccaccccggctacagcagcgaggggccgcagaggccctgctcttccggctacagacagcactccaagcccagaaccgcaggcccttcctgcctcatgagggcctgggccttgcagagctgtcccagtgctgggcagggctggagtgggcagaggctgcaaggagccaggccctgcagcagaggctactgcagctgcagcggctagaaaccctggcccggcgcttccagcacaaggcagccctccgggagagtttccttaaggatgcagagcaggtgctagaccaggccagagccccgccagccagcctggccacagtggaggcagccgtccagaggctgggcatgctggaggctggcatcctgccccaggaggggcgcttccaggccctggctgagatcgcagacatcctccggcaggagcagtaccacagctgggcagatgtggcccgcaggcaggaggaagttaccgtgcgctggcagaggctccttcagcatctacagggacagaggaagcaggtggcagacatgcaggctgtgctgagcctgctgcaggaggtggaggctgcctcccaccagctggaggagctgcaggagccggccaggtccaccgcctgtgggcagcagctggcagaagtggtggagctgctgcagaggcatgacctgctggaggctcaagtctcggcccacggagcccatgtgagccatcttgctcagcagacagcagagctggactcctccctgggcaccagtgtggaggtgctgcaggccaaggccaggacactggcccagctccaacagagcctggtggctcttgtcagggcccggcgggccctgctggagcagaccctgcagcgggcagagttcctgcgcaactgtgaggaggaggaagcctggctgaaggagtgcggacagcgggtggggaatgcggccctgggccgggatctcagccagatcgcaggcgccctgcagaaacacaaggccctggaagctgaggtccaccgccaccaggccgtgtgcgtagatctcgtgcggaggggacgcgacctcagcgcccgcaggcccccaacgcagccggatcccggggaacgggcagaggccgttcagggagggtggcagctgctccagacccgggtggtggggcggggcgcacggctgcagacagccctgctggtcctgcagtacttcgcggacgcggcggaggcggcttcgtggctgcgcgagcggcgatcctcgctggagagagcgtcctgcggtcaggaccaggcggccgccgagaccctgctgaggcgccacgtgcggctggagcgcgtcctgcgcgccttcgcggccgagctgcggcggctggaggagcaggggcgggcggcctcggcccgggcgtcgttattcacggtgaactctgccctgagccctccaggagaaagcctgaggaacccagggccctggagtgaggcttcctgccaccctggccctggggatgcctggaagatggccctcccagctgagcctgaccctgactttgatcccaacactatactccagacacaggaccacttgagtcaggactatgagagtctgcgggccctggcacagctccgcagggcccggttggaggaggccatggccctgttcggtttctgcagttcctgtggggagctccagttgtggctggagaagcagacagtgctgctccaaagggtgcagccccaggctgacaccctggaggtcatgcagctcaaatatgagaacttcctcactgccctggctgtgggaaagggcctctgggctgaggtcagcagctctgctgagcaactgaggcagagatatcctgggaactccacacaaatccaacgacagcaggaggaactgagccagaggtgggggcagctggaggccctgaagagggagaaggccgtgcagctggcacacagtgtggaagtgtgcagttttctgcaggagtgtggacccacacaggtccagctgcgagacgtgctcctccagctggaggccctgcagccagggagctcagaggacacctgccacgccctgcagctggcccagaagaagaccctggtgctggagaggagggtccacttcctccaaagtgtggtcgtaaaggtcgaggagccaggctacgcagagagccagcctctgcaaggacaggtggagacactgcaggggctgctgaagcaagtacaggaacaagtggcccaacgggcccggcgccaggctgagactcaggcccggcagagcttcctgcaagagagccagcaactgctactgtgggcagagagtgtccaggctcagctgcgcagcaaggaggtgtcagtggatgtggcctcggctcagcggctgctgagggagcaccaagacctgctggaggagatccacctgtggcaggagaggctgcagcagctggacgctcagagccagcccatggcagccttggactgcccagactcccaagaggtgcccaacactctgagggtcctggggcagcagggccaggagctgaaggttttgtgggagcagaggcagcagtggctgcaagaggggctggagctgcagaagtttggccgagaagtggatggtttcactgccacctgtgccaaccaccaggcctggctgcacctggacaaccttggggaggacgtgagggaggccctgagcctgctgcagcagcaccgggagtttgggcggctcctgagcaccctggggcctcgggcagaggctctgcgggcacacggcgagaagctggttcagagccagcacccagctgcacacacggtcagagagcagctgcagagtatccaggcacagtggaccaggctccaggggaggagtgagcagaggaggaggcagttgctggcttccctccagctccaggagtggaagcaggatgtggcagagctgatgcagtggatggaagagaaggggctgatggctgcgcatgagccctccggagcgcgcagaaacatcctgcagacactcaagcggcacgaagcagctgagagcgagctactcgccacccgcagacacgtggaggccctgcagcaggttgggagagagctgttgagtaggaggccctgtggccaggaggacatacagaccaggcttcaaggcctgagaagcaagtgggaagctttgaaccgcaagatgactgagcgtggggacgagctccagcaggctggacagcaggagcaactcctgaggcagctgcaggatgcaaaggagcagctggagcagctcgaaggggccctacagagctcggaaacagggcaggacctgcgctccagccagaggctgcagaaacggcaccaacagctggagagtgagagccggaccctggctgccaagatggctgccctcgcctccatggcccatggcatggccgcctccccggccatcctggaagagacccagaagcacctccggaggctggagcttctgcaggggcatctggccatccggggcctgcagctgcaggcctcagtggagctgcaccagttctgccacctgagcaacatggagctctcttgggtagccgagcacatgccccatggcagccccaccagctataccgagtgcttgaatggtgcccagagccttcaccgcaagcacaaggagctccaggtggaggtaaaagctcaccaggggcaggtgcaacgggtgctgagttctgggcggagcctggcagcctcagggcacccccaagcccaacacatcgtggagcagtgccaggagctggaaggccactgggcagagctggagagggcatgtgaagcgcgggcccagtgtctgcagcaggctgtcactttccagcagtactttctggatgtgtcagagctggagggctgggtggaggagaagcggccgctggtgagcagtcgggactatggcagagacgaggcagccaccctcaggctcattaacaagcaccaggctctacaggaggaactagccatttactggagctccatggaggagcttgaccagacggcccaaaccctcactggccccgaagtccctgagcagcagcgtgtggtgcaggagaggctccgggagcagctgcgggcactgcaggagttggcggccacacgggaccgggaactggaggggaccctgaggctgcatgagttcctgagggaggctgaggacctgcagggctggctggcaagccagaagcaggcagccaaaggaggggagagcctgggagaggaccccgagcacgccctgcacctctgcaccaagtttgcaaagtttcagcaccaagtggagatgggcagccagcgggtggccgcctgccggctgctggcggagagcctgctagagcgtgggcacagtgctggccccatggtccgtcagaggcagcaggatctgcagaccgcctggtcggagctgtgggagctgacccaggcccgaggccacgcgctccgagacaccgagaccaccctcagagttcacagagatctcttggaagtcctcacccaggtccaggagaaagccacgagcctccccaacaatgtggcacgggacctgtgtgggctggaggcgcagctgagaagccaccaggggctggagcgagaactcgtgggcaccgagcggcagctgcaggaactgctggagactgcaggcagggtgcagaagctgtgtccggggcctcaggcccatgcggtgcagcagaggcagcaagctgtgacgcaggcgtgggcagtgctgcagcgacgcatggagcagcgcagggcccagctggagcgggcacgcctcctggcccgcttccgcacggcggtgcgtgactatgcctcctgggcagcccgcgtgcgccaggacctgcaggtggaggagagttcgcaagagcctagcagtggcccgctgaagctcagtgcccaccagtggctccgggcggagctggaggcccgggagaagctgtggcagcaggccacccagctggggcagcaggcacttcttgctgcagggacacccaccaaggaggtccaggaagagcttcgagccctgcaggaccagcgggaccaggtgtatcagacctgggcacggaagcaagagaggctgcaggccgagcagcaggagcagctcttcctcagagagtgcggccgcctggaggagatcctcgcggcccaggaggtctccctgaaaaccagtgccttggggagctcggtggaagaggtagagcagttgattcgcaagcacgaggtcttcctgaaggttctgactgcccaggacaagaaggaggcagccctgcgtgagcggctgaagacgctccggcgcccccgggtgcgggaccggcttcccatcctgctgcagcgccggatgagagtgaaggagctggcggagagccggggacacgccctgcatgcctccctgctgatggccagcttcacccaggccgcaacccaggctgaggactggatccaggcgtgggcccagcagctgaaggagccggtccctcctggggacctgagagataagctgaagcccctgctgaaacaccaggcctttgaggctgaagtccaggcccatgaggaggtcatgacctctgttgccaagaagggagaggctctcctggcacagagtcaccctcgagccggagaggtctcccagcggctgcagggcctgcggaagcactgggaggacctgaggcaggcaatggccctcaggggccaggagctggaggacaggcggaacttcctggagttcctgcagagagtggaccttgcagaggcctggatccaggagaaggaggtgaagatgaatgttggtgacctgggccaggacctggagcactgcctgcagctccgacggcggctccgcgagttccgaggaaactcggccggggacacagtgggtgatgcctgcatcaggagcatcagtgacttgtcactgcagctcaagaaccgggaccctgaggaagtcaagatcatctgccagcggcgaagccagctcaacaacaggtgggcgagtttccatggcaacttgctccggtaccagcagcagctcgaaggggccttggagatacacgtgttgtcccgagagctggacaatgtcaccaagaggattcaggagaaggaagccctgatccaggccctggactgtgggaaagatctggagagcgtgcagaggctgctgcggaaacacgaggagctggagcgggaagtgcaccccatccaggcccaggtggagtccctagagcgtgaagtgggccgcctctgccaaagaagccccgaggcagcccacggcctcaggcacaggcagcaggaggtggctgagagctggtggcagctccggagcagggcccagaagcggagggaggcgctggatgccttgcaccaagctcagaaactccaggcaatgctgcaggaattgctggtcagcgcccagaggctgcgggctcagatggacacgagccccgctcctcgcagccctgtggaagcccggcgtatgttagaagagcatcaggagtgcaaggccgagctggactcctggacagacagcatcagcctggcccgaagcactgggcagcaactgctcacagcggggcaccccttcagctccgacattcgccaggtgctggctggcttagaacaggagctgagcagcctggaaggggcctggcaggagcatcagctacagctgcagcaggccctggagctacagctgtttctgagctcagtggagaagatggaacgttggctttgcagcaaggaagactccctagccagtgagggtctatgggaccccttggcccccatggagccccttctgtggaagcacaagatgctggagtgggacctggaggtgcaggcgggaaagatcagtgctctggaggccacggcccgcggcctgcaccagggtgggcaccccgaggcccagagtgccctgggcaggtgccaggccatgcttctgaggaaggaggcgctcttcaggcaagccgggacccgccgccatcgcctggaggagctccggcagctgcaggccttcctgcaggactcccaggaggtggctgcgtggctgagggagaagaacctggtggccttggaggagggtttgctggacacagccatgctgccagcacagttacagaagcagcagaatttccaggcggagctggacgcgagcatgcaccaacagcaggagctgcagcgggagggacagaggctgctgcaggggggccacccagcctcggaggccatccaggagcgactggaggagctgggagcactctggggtgagctgcaagacaactcccagaagaaggtggccaagctccagaaggcctgtgaggccctgcgtctgcggcggagcatggaggaactggagaactggctggagcccatcgaggttgagctgagagcccccactgtgggccaggccctgcctggggtgggcgagctcctgggcacacagagggagctggaggcagcagtggacaagaaggccaggcaggctgaggcactgctgggccaggcccaggcctttgtgagggaaggccactgccttgcccaagatgtggaagagcaggcccggcggctgcttcagaggttcaagagcctgagggagcccctgcaggagcgcaggacggccctggaggcccggagcctcctcttgaagttcttcagggacgccgacgaggaaatggcctgggtgcaggagaagctgcctctggccgctgcccaggactatggccagagcctgagtgcggtgcggcacctgcaggagcagcaccagaacctggagagtgagatgagcagccacgaggctctgacccgggtggtgctgggcactgggtacaagctggtgcaggctgggcactttgccgcccacgaggtggccgcccgggtgcagcagctggagaaggccatggcccacctgcgggcagaggcggcgcggaggcggcttctgctgcagcaggctcaggaggcccagcagtttctgactgagctcctggaggcgggatcctggctggctgagcggggccatgtcctggacagcgaggacatgggccacagtgctgaagccacacaggcccttctgcggcggctggaggccaccaagagagacctggaagcgttcagcccacgcatcgagcggctgcagcagacagcagcactcctggagagcaggaagaacccagaaagccccaaggtgctagcccagctgcaggcagttcgggaggcccacgcagagctgctgcggagggcggaggccagggggcacggcctgcaggagcagctgcagctacaccagctggagcgagagaccctgctcctcgacgcctggctgaccaccaaggcggccaccgccgagtcccaggactacgggcaggacctggagggtgtcaaggtgctggaagagaagtttgatgctttcagaaaggaagtgcagagcctgggccaggccaaggtgtatgccctgaggaagttggcaggcaccctggagcggggtgcacccaggcgctatccccacatccaagcccagaggagccgcattgaggctgcttgggagaggttggaccaagcaataaaagcccgcacagagaacttggctgcagcccatgaggtccacagctttcagcaggcagcagctgagctccagggaaggatgcaggagaagacggccctgatgaagggggaggacggaggccacagcctgtcatctgtgcggaccctgcagcaacagcacaggcgcctggagagagagctggaagctatggagaaggaggtggcacggctacagacggaggcctgccgactgggccagctacatcctgcagctccggggggcctggccaaggtgcaggaggcctgggccaccctgcaggcgaaggcccaggagcgaggccagtggctggcgcaggctgcacagggccatgccttcctcgggcgctgccaggaactgctagcatgggcacaggagaggcaggagctggcgtcctccgaggagctggctgaggacgtggcgggggctgagcagctccttgggcagcatgaagagctggggcaagaaatcagggagtgccgccttcaagcccaggacctgcggcaggaaggacagcagctggtggacaacagccacttcatgtctgcggaggtgacagagtgcctgcaggagctggaagggcggctgcaggagctggaggaggcttgggccctgcgctggcaacgctgtgccgagagctggggcctgcagaagcttcggcagaggctggagcaggctgaggcctggctggcctgctgggagggactcctgctgaagcccgactatgggcactcagtgtcagatgtggagttgctgctgcacagacaccaggacttagaaaagctgctggcagcccaggaagagaagtttgcccaaatgcaaaagacagagatggaacaggagctcctgctgcagccacaggagctgaagcccgggagagctggcagctcgctgacatcctttcagtggaggccctctggacaccaggggctaggagcacagctggctgagacgagggacccccaggatgcaaagggtacccccaccatggaggggtctttggagttcaagcagcacctgctgcctggcgggaggcagcctagctcgagctcctgggacagctgccgcgggaacttgcagggcagctctctgagcctgttcctggatgagaggatggcagcggagaaagtagcttccatagccctccttgacctcacgggagcccggtgtgagaggctgcggggccgccacggcaggaaacacacattctccttaaggctgaccagtggggcagagatcctgtttgcagcaccgtccgaagagcaggctgagagctggtggcgagccctgggcagcactgcagcccagagtctgagcccaaaactcaaagccaaacctgtcagctctctgaatgagtgcacgaccaaggatgcccggcctggatgtctactcaggtctgatccctgaggtgaaccccagtgcaacaccaaacttcaggggcacaagcgaggacacatctaagggaccagaataagactcagctacaggcaaaagggctccttcccgtggctgcttcaacccagttccccaggcccagcttctggaatagacagttccttctggttagatgggtcctaccatgtggcaggaaacagccattgcctggcctccccctgcattcctgtctgggtgaagaggagacgtgttacggcagagcaggtgggcaaggccagggctaccccaggcccatgtggcctcctccttgcttggaaggggtgactctgagcacaggtagacgcagacgtgtgcagagaatgtgctcttcggaggaagaacactgatgagcgagctctgtaccagcccttgccatgtacagccaagagcctagaatgacatggcccttctcagcagtaataacagatggtctcagcgcctc

SEQ ID NO: 29670 - DNA, 1801 bp, Homo sapiens
agcgaccgacgagcaaccgtctgaggccaggagcgctgcgacggagccttgaccgccgttgcccggccctctcccgcgcagccccgggcttccgcagtccttccttcagaagggaaatttctgagggtcaggaaggggaatctgtacctcactccttgaacaccaaggaaggaatattgggaaaccaaaatgaggcacaatcagatgtgttgtgagacaccacctactgtcactgtttatgtaaaatcagggtcaaatagatcacatcagcctaaaaagcccattactctgaagcgtcctatttgtaaagataattggcaagcatttgaaaaaaatacacataataacaacaaatctaaacgccccaaaggaccttgtctggttatacagcgtcaggatatgactgctttctttaaattatttgatgacgatttaattcaagatttcttgtggatggactgctgctgtaaaattgcagacaagtatcttttggctatgacctttgtttatttcaagagggctaaatttactataagtgagcataccaggataaatttctttattgctctgtatctggctaatacagttgaagaagatgaagaagaaaccaagtacgaaatttttccatgggctttagggaaaaactggagaaaattgttccctaatttcttaaagttaagggaccagctctgggatagaattgactatagggctattgtaagcaggcgatgttgtgaggaggttatggccattgcaccaacccattatatctggcaaagagaacgttctgttcatcacagtggagctgtcagaaactacaacagagatgaagttcagctgccccggggacctagtgccacaccagtagattgttcactctgtggtaaaaaaagaagatatgttagactgggattgtcttcatcatcatctttatccagtcatacagcaggggtgacagaaaaacattctcaggactcatacaactcactgtcaatggacataataggtgatccttctcaagcttatactggttctgaagtagtcaatgaccatcaatcaaataaaggaaagaaaactaatttcttgaagaaagacaaatctatggagtggtttacaggaagtgaagaatgagatggcccaactaaaccaatttggaatcattaactacaaaatgtcaaactaactgcaagacaagtgtcaaaatgggatgtttaagcagttttgctatgttatacatcttttagttgttattttcaaaattatatgtataagttatataagtcatagtaatagctaaaaatgccaatctatggaagcagtgattttcaatataaagttctattttgatatttttccatcttcaagtcagttactgtcatctggagtactcagttaagttgtggtttgaccttcctcaacttgacaagaaaagctaatttaagagaagaaaaacataaagtcattatattaattaaaagaaaaaacaccatttaatatgttctgaaaacattactcacctgtatgaccaggttgccagtgtactggtctagcaacatagggaaatgatccatatggaaaatcagaatgcgattcttctgttgtaaaaaaatatatgtactataagctacataaaatattttctatttttttcacaaaactgttaaaatatgagttactctctttattgtaagttttttctttatttatttccttgcatatgttttagagctactctgccagttattatacagaaactatttgtcaatgattatgtaataaacatatgattttataaccaaat

SEQ ID NO: 29671 - DNA, 1759 bp, Homo sapiens
gggagaccttagagcgggtaccgctgctggctagcgaccgacgagcaaccgtctgaggccaggagcgctgcgacggagccttgaccgccgttgcccggccctctcccgcgcagccccgggcttccgcaggaatattgggaaaccaaaatgaggcacaatcagatgtgttgtgagacaccacctactgtcactgtttatgtaaaatcagggtcaaatagatcacatcagcctaaaaagcccattactctgaagcgtcctatttgtaaagataattggcaagcatttgaaaaaaatacacataataacaacaaatctaaacgccccaaaggaccttgtctggttatacagcgtcaggatatgactgctttctttaaattatttgatgacgatttaattcaagatttcttgtggatggactgctgctgtaaaattgcagacaagtatcttttggctatgacctttgtttatttcaagagggctaaatttactataagtgagcataccaggataaatttctttattgctctgtatctggctaatacagttgaagaagatgaagaagaaaccaagtacgaaatttttccatgggctttagggaaaaactggagaaaattgttccctaatttcttaaagttaagggaccagctctgggatagaattgactatagggctattgtaagcaggcgatgttgtgaggaggttatggccattgcaccaacccattatatctggcaaagagaacgttctgttcatcacagtggagctgtcagaaactacaacagagatgaagttcagctgccccggggacctagtgccacaccagtagattgttcactctgtggtaaaaaaagaagatatgttagactgggattgtcttcatcatcatctttatccagtcatacagcaggggtgacagaaaaacattctcaggactcatacaactcactgtcaatggacataataggtgatccttctcaagcttatactggttctgaagtagtcaatgaccatcaatcaaataaaggaaagaaaactaatttcttgaagaaagacaaatctatggagtggtttacaggaagtgaagaatgagatggcccaactaaaccaatttggaatcattaactacaaaatgtcaaactaactgcaagacaagtgtcaaaatgggatgtttaagcagttttgctatgttatacatcttttagttgttattttcaaaattatatgtataagttatataagtcatagtaatagctaaaaatgccaatctatggaagcagtgattttcaatataaagttctattttgatatttttccatcttcaagtcagttactgtcatctggagtactcagttaagttgtggtttgaccttcctcaacttgacaagaaaagctaatttaagagaagaaaaacataaagtcattatattaattaaaagaaaaaacaccatttaatatgttctgaaaacattactcacctgtatgaccaggttgccagtgtactggtctagcaacatagggaaatgatccatatggaaaatcagaatgcgattcttctgttgtaaaaaaatatatgtactataagctacataaaatattttctatttttttcacaaaactgttaaaatatgagttactctctttattgtaagttttttctttatttatttccttgcatatgttttagagctactctgccagttattatacagaaactatttgtcaatgattatgtaataaacatatgattttataaccaaat

SEQ ID NO: 29672 - DNA, 758 bp, Homo sapiens
gttgcccggccctctcccgcgcagccccgggcttccgcaggtacctgtgctcgcccccgggaaggggcctcgcaggcgaatctccagtttcgagtgtgcccggtccctgggttcgctcgccggcgaccccaccgcccgccttagatgagaaggcagcgctccagcctcgtcctcacgccgcctcccgtgggcgccctcagctgccttcgcggcgacgacacacgcgctccccgcagcgggctctgggctgagggacctggcgagggaggcagtggccgcgcagtccttccttcagaagggaaatttctgagggtcaggaaggggaatctgtacctcactccttgaacaccaaggaaggaatattgggaaaccaaaatgaggcacaatcagatgtgttgtgagacaccacctactgtcactgtttatgtaaaatcagggtcaaatagatcacatcagcctaaaaagcccattactctgaagcgtcctatttgtaaagataattggcaagcatttgaaaaaaatacacataataacaacaaatctaaacgccccaaaggaccttgtctggttatacagcgtcaggatatgactgctttctttaaattatttgatgacgatttaattcaagatttcttgtggatggactgctgctgtaaaattgcagacaagtatcttttggctatgacctttgtttatttcaagagggctaaatttactataagtgagcataccaggataaatttctttattgctctgta

SEQ ID NO: 29673 - DNA, 991 bp, Homo sapiens
gaaggccctgattggtggacgggctgctttgggcagggccgccctcaggctatataagcgcactcgcggcggcgttggtgttatgctctgggccattcctgagctcgggtcaccctgccccatctccatctcctatgagatgagtgactcccaagaccccaccacttcccctgtagttaccacccaggtagagctggggggctgcagccggcaaggtgggggcaatgggttcctccgttttcgccagcaccaggaggtccaggccttcctcagccttctggaggacagttttgtccaggaattcctctccaaagacccctgcttccagatttcagataagtatctcctggccatggtgctggtctacttccagcgcgcccacctgaagctcagcgagtatacccacagcagcctgttcttggccctgtaccttgcaaacgacatggaggaggacctggagggccccaaatgtgagatttttccatgggccctgggaaaagattggtgtttacgagtggggaaattcctgcaccagagggataagctttgggcacggatgggtttccgggctgttgtgagccgccagtgctgtgaggaggtcatggcaaaggagccattccactgggcttggactcgggaccggcgcccccaccatggtggggttcagagggtctgtccacaggtccctgttcgccttccccggggccctggcctctcgccgccccactgttccccctgtggtttgccccagcactgcagcagccacttgcttaagcctgtgtcatccaagtgcccttctctgacctctgaatgtcatcgccctccctcccaaaattatctctcaagggtcaaaaacgcctggggtggggactttctcatcgtcttgcctccccagatgcaactggaaccaggcacctactccctccgcatcttcccaaagcctccggcacgccctgggcactgaagctctgcagggtgaagaacagcacgc

SEQ ID NO: 29674 - DNA, 2855 bp, Homo sapiens
atgaatgtggataaatttctaattgtctgctatctcaagaaagaagtctgggggtttgagagttacagtttgtctgggactacttgcttccagtggaattattttgtctggtcactaagattttttttttcttgtggttcatctaaatatcatttgacacccttgcccattaagaaggtggattacccccataagaggggccaaaattggggaagttatgttcacaattctctccctagatttaattgggattataggtcgtgtttccacacttggaaaagggcttcagataacagggagcgtgcttatgaacatagtgcctatggacaccatgaacgggggacgggaggatttgatcggacaagacattacgatcaggattactatagagatcctcgagagcggactttacaacatgggctctattacgcttctcggagtcgaagtccaaatcgctttgatgctcatgacccccgatatgaacctagggctcgcgagcagtttacactgcccagtgtggtacacagggatatctacagggatgatattacccgggaggtacgaggcagaaggccagagcggaattaccagcacagcaggagtcggtcaccacattcatcccagtctagaaatcagtctcctcagagactggctagccaagcatctagacccacaaggtcccctagcggcagcggctctagaagtagatcctccagtagtgattcaatcagcagcagcagtagtaccagcagtgacagcagtgattccagcagtagttcaagtgatgattctccagctcgatcagttcagtctgcagcagtccctgcacccacttcccagttgctttcatctctggaaaaagatgagccccgtaaaagttttggcatcaaggtccagaatcttccagtacgctctacagatacaagccttaaagatggccttttccatgaatttaagaaatttggaaaagtaacttcagtgcagatacatggaacttcagaagagaggtatggtctggtattctttcggcagcaagaggaccaagaaaaagccttgactgcatcaaaaggaaaacttttctttggcatgcagattgaagtaacagcatggataggtccagaaacagaaagtgaaaatgaatttcgccccttggatgaaaggatagatgaatttcaccccaaagcaacaagaactctctttattggcaaccttgaaaaaaccactacttaccatgaccttcgcaacatcttccagcgctttggagaaattgtggatattgacattaagaaagtaaatggagttcctcagtatgcgtttctgcaatactgtgatattgctagcgtttgtaaagctattaagaagatggatggggaatatcttggaaataatcgcctcaagctgggttttggaaagagcatgcctacaaactgcgtgtggctagatgggctttcttcgaatgtgtcagatcagtatttaacacgacatttctgccgatatgggcctgtggtaaaggtggtgtttgaccgcttaaaaggcatggccctggttctctacaatgaaattgaatatgcacaagcagctgtaaaagagaccaaagggaggaaaatcggtgggaataaaattaaggtggattttgcaaatcgggaaagtcagctggctttttatcactgcatggagaaatctggtcaagacatcagagacttttatgaaatgttagccgaaagaagagaggaacgaagggcatcctacgactataaccaagatcgtacatattatgagagtgttcgaactccaggcacttatcctgaggattccaggcgggactatccagctcgagggagagagttttattcagaatgggaaacttaccaaggagactactatgaatcacgatactacgatgatcctcgggaatacagggattacaggaatgatccttatgaacaagatattagggaatatagttacaggcaaagggaacgagaaagagaacgtgaaagatttgagtctgaccgggacagagaccatgagaggaggccgattgaacgaagtcaaagtcctgttcacttgcgacgtccacagagtcctggagcgtctccctctcaggcagagaggttgccgagtgattctgagaggaggctttacagccgatcctcagaccggagtggaagctgtagctcactctcccctccaagatatgagaaactggacaagtctcgtttggagcgctatacaaaaaatgaaaagacagataaagaacgaacttttgatccggagagagtggagagagagagacgcttaatacggaaggaaaaagtggaaaaggacaaaactgacaagcagaaacgcaaaggaaaggttcactcccctagttctcagtcttcagaaacggaccaagaaaatgagcgagagcaaagccctgaaaagcccaggagttgtaataaactgagcagagagaaagctgacaaagagggaatagcgaaaaaccgcctggaactcatgccttgcgtggttttgactcgagtgaaagagaaagagggaaaggtcattgaccacactcctgtggaaaagttgaaagccaagcttgataatgacactgtcaaatcttctgccctggaccagaaacttcaggtctctcagacggagcctgcaaaatctgacttgtctaaactggaatcagttagaatgaaagtaccaaaggaaaaggggctttcaagccatgttgaagtggtggagaaggaaggcaggcttaaagccaggaagcacctcaagcctgagcagcctgcagatggggtaagtgctgtggatctggagaagctggaagccaggaaaaggcgctttgcagattccaattt

SEQ ID NO: 29675 - DNA, 12232 bp, Homo sapiens
tgagctgcgaggcccgagagtcagaacctgggggagagggatggtctctgcacgggggggagccggaggagccgccgccgctgccgacgccaccgccgcagccgccgccgccgccgccccggcacccgcctcccggcgctgacggtctcgtacgaagccggcgagggggagccagcagcggcggtcgccggcacgccgcccagcatggtccgggaaaccaggcatctctgggtgggcaacttacccgagaacgtgcgggaagagaagatcatcgagcatttcaaacgatatggccgcgtggaaagtgtcaaaattcttcccaagaggggatctgaaggaggagtggctgcctttgtggattttgtggacatcaaaagtgcacagaaagctcacaactcggtcaacaaaatgggtgacagagacctacgcacggattataatgaaccaggcaccatcccgagtgctgctcggggattggatgatacagtttccatagcatctcgtagtagagaggtttctgggttcagaggaggtggtggagggcctgcttatggtcccccaccgtcacttcatgcacgagaaggacgttatgagcggagacttgatggggcttcagataacagggagcgtgcttatgaacatagtgcctatggacaccatgaacgggggacgggaggatttgatcggacaagacattacgatcaggattactatagagatcctcgagagcggactttacaacatgggctctattacgcttctcggagtcgaagtccaaatcgctttgatgctcatgacccccgatatgaacctagggctcgcgagcagtttacactgcccagtgtggtacacagggatatctacagggatgatattacccgggaggtacgaggcagaaggccagagcggaattaccagcacagcaggagtcggtcaccacattcatcccagtctagaaatcagtctcctcagagactggctagccaagcatctagacccacaaggtcccctagcggcagcggctctagaagtagatcctccagtagtgattcaatcagcagcagcagtagtaccagcagtgacagcagtgattccagcagtagttcaagtgatgattctccagctcgatcagttcagtctgcagcagtccctgcacccacttcccagttgctttcatctctggaaaaagatgagccccgtaaaagttttggcatcaaggtccagaatcttccagtacgctctacagatacaagccttaaagatggccttttccatgaatttaagaaatttggaaaagtaacttcagtgcagatacatggaacttcagaagagaggtatggtctggtattctttcggcagcaagaggaccaagaaaaagccttgactgcatcaaaaggaaaacttttctttggcatgcagattgaagtaacagcatggataggtccagaaacagaaagtgaaaatgaatttcgccccttggatgaaaggatagatgaatttcaccccaaagcaacaagaactctctttattggcaaccttgaaaaaaccactacttaccatgaccttcgcaacatcttccagcgctttggagaaattgtggatattgacattaagaaagtaaatggagttcctcagtatgcgtttctgcaatactgtgatattgctagcgtttgtaaagctattaagaagatggatggggaatatcttggaaataatcgcctcaagctgggttttggaaagagcatgcctacaaactgcgtgtggctagatgggctttcttcgaatgtgtcagatcagtatttaacacgacatttctgccgatatgggcctgtggtaaaggtggtgtttgaccgcttaaaaggcatggccctggttctctacaatgaaattgaatatgcacaagcagctgtaaaagagaccaaagggaggaaaatcggtgggaataaaattaaggtggattttgcaaatcgggaaagtcagctggctttttatcactgcatggagaaatctggtcaagacatcagagacttttatgaaatgttagccgaaagaagagaggaacgaagggcatcctacgactataaccaagatcgtacatattatgagagtgttcgaactccaggcacttatcctgaggattccaggcgggactatccagctcgagggagagagttttattcagaatgggaaacttaccaaggagactactatgaatcacgatactacgatgatcctcgggaatacagggattacaggaatgatccttatgaacaagatattagggaatatagttacaggcaaagggaacgagaaagagaacgtgaaagatttgagtctgaccgggacagagaccatgagaggaggccgattgaacgaagtcaaagtcctgttcacttgcgacgtccacagagtcctggagcgtctccctctcaggcagagaggttgccgagtgattctgagaggaggctttacagccgatcctcagaccggagtggaagctgtagctcactctcccctccaagatatgagaaactggacaagtctcgtttggagcgctatacaaaaaatgaaaagacagataaagaacgaacttttgatccggagagagtggagagagagagacgcttaatacggaaggaaaaagtggaaaaggacaaaactgacaagcagaaacgcaaaggaaaggttcactcccctagttctcagtcttcagaaacggaccaagaaaatgagcgagagcaaagccctgaaaagcccaggagttgtaataaactgagcagagagaaagctgacaaagagggaatagcgaaaaaccgcctggaactcatgccttgcgtggttttgactcgagtgaaagagaaagagggaaaggtcattgaccacactcctgtggaaaagttgaaagccaagcttgataatgacactgtcaaatcttctgccctggaccagaaacttcaggtctctcagacggagcctgcaaaatctgacttgtctaaactggaatcagttagaatgaaagtaccaaaggaaaaggggctttcaagccatgttgaagtggtggagaaggaaggcaggcttaaagccaggaagcacctcaagcctgagcagcctgcagatggggtaagtgctgtggatctggagaagctggaagccaggaaaaggcgctttgcagattccaatttaaaagcagaaaagcaaaaaccagaggtcaagaaaagcagtccagagatggaggatgctcgcgtgctttcaaaaaagcagcctgacgtgtcctctagagaggtcattctgctgagggaaggagaggctgaaagaaagcctgtgaggaaagaaattcttaaaagagaatctaaaaaaatcaaactggacagacttaatactgttgccagccccaaagactgtcaggagcttgccagtatttctgttgggtctggctcaaggcccagctcagacctacaagcaagactgggagaactagcaggtgaatctgtggaaaatcaagaagtccaatcaaaaaagcccattccctcaaaaccacagctcaaacagctgcaggtattagatgatcaaggaccagagagagaagacgttaggaaaaactattgcagtcttcgtgatgaaacacctgaacgtaaatcaggccaagagaaatcacattcagtaaatactgaagaaaaaattggcattgacatcgatcacacgcagagttaccgaaaacaaatggaacagagtcgtaggaaacagcagatggaaatggaaatagccaagtctgagaagtttggcagtcctaaaaaagatgtagatgaatatgaaagacgtagcctcgttcacgaggtaggcaaaccccctcaagatgtcactgatgactctcctcctagcaaaaagaaaaggatggatcatgtcgattttgatatctgcaccaagcgagaacggaattacagaagttcacgccaaatcagcgaagattctgaaaggactggtggttctcccagtgtccgacatggttccttccatgaagatgaggatcccataggctcccctaggctactgtcagtaaaagggtctcctaaagtagatgaaaaagtcctcccctattctaacataacagtcagggaagagtctttaaaatttaatccttatgattctagcaggagagaacagatggcagatatggccaaaataaaactatctgtcttgaattctgaagatgaactaaatcgttgggactctcagatgaaacaggatgctggcagatttgatgtgagtttcccaaacagcataattaagagagatagccttcgaaaaaggtctgtacgagatctggaacctggtgaggtgccttctgattctgacgaagatggtgaacacaaatcccactcacccagagcctctgcattatatgaaagttctcgattgtcttttttattgagggacagagaagacaagctacgtgagcgagatgaaagactctctagttctttagaaaggaacaaattttactcttttgcattggataagacaatcacaccagacactaaagctttgcttgaaagagctaaatccctctcttcatctcgtgaagaaaattggtcttttcttgattgggactcccgatttgcaaattttcgaaacaacaaagataaagaaaaggttgactctgctccaagacctattccatcctggtacatgaaaaagaagaaaattaggactgattcagaagggaaaatggatgataagaaagaggaccataaagaagaagagcaagagaggcaggaattgtttgcttctcgttttttacacagctcaatctttgaacaagattccaagcgattgcagcatctagagagaaaagaggaagattctgacttcatttctggtaggatctatgggaagcagacatctgagggagcaaacagcacaactgattccattcaagaaccagtagttctgttccatagcagatttatggagctcacacggatgcaacagaaagaaaaagaaaaagaccagaaacccaaagaggttgagaaacaggaagatacagagaatcatcccaagaccccagaatctgctcctgagaataaagattcagaactgaaaactccaccttccgttgggcctccaagtgtcacagtcgtaactctagaatcagccccatcagcactagagaagaccactggtgacaaaacggtagaggcgcctttggtaacagaagagaagactgtggagccagctaccgtctcagaagaagcaaagcctgcatctgaacctgctcctgcccctgtggaacagctggaacaagtagacctgcccccaggagcagaccccgataaagaagctgccatgatgcctgcgggtgttgaggaaggttcatcaggtgaccagccgccttatctggatgccaagcctccaactcccggggcctcgttttcccaggcagagagcaacgtagatccagagcctgacagtacccagccactttcaaaaccagctcagaagtctgaggaagccaatgagccaaaggccgaaaagccagacgccactgcagatgctgagcctgatgcaaaccagaaagccgaagctgctcctgagtctcagcccccagcttctgaagatttagaggttgatcctccagttgctgcaaaggataaaaagccaaacaaaagcaagcgttcaaagacccctgttcaggcagctgcagtgagtatcgtggagaagcccgtcacaaggaagagtgagaggatagaccgggaaaaactcaagcggtccaattctcctcggggagaagcacagaagcttttggaattgaagatggaggcagagaagattacaaggactgcttctaaaaactctgctgcagaccttgaacatcccgaaccaagtttgcctctcagccgaacaaggcgccggaatgtaaggagcgtctatgcaaccatgggtgaccatgaaaaccgctctcctgtcaaagagcccgttgagcaaccaagagtgaccagaaagagattggagcgagagcttcaggaggctgcagcggttcccaccacccctcggaggggaaggcctccaaagacacgccggcgagccgatgaagaggaggagaacgaggccaaggaacctgcagaaacactcaagccacctgagggatggcggtcgccaaggtcccagaaaactgcagctggtggtggaccccaagggaaaaagggaaaaaatgaaccgaaggtggatgctacacgtcctgaggccaccactgaggtgggcccccaaataggcgtgaaagagagctccatggaacccaaggctgctgaggaggaggcagggagtgaacagaaacgtgacagaaaagatgctggcacagacaaaaacccccctgaaaccgcccctgttgaagttgtagagaaaaaaccggcccctgaaaaaaactccaaatcaaagagaggaagatctcgaaactccaggttagcagtggacaaatctgcaagtctgaaaaatgtggatgctgctgtcagtcccaggggggctgcagcacaggcaggggagagggaatctggggtggtggcagtctcccctgagaaaagtgagagtccccaaaaggaggatggtttatcatcccagttgaaaagtgatccagttgatccagacaaggaaccagagaaagaagacgtgtctgcctctgggccgtccccagaagccacccagttagccaagcagatggagctggagcaggccgtggaacacatcgcaaagctcgctgaggcctctgcctctgctgcctataaggcagatgcaccagagggccttgccccagaggacagggacaagcctgcacaccaagcaagtgaaacagagctggctgcggccatcggctccatcatcaatgacatttctggggagccagaaaacttcccagcacctccaccttatcctggagaatcccagacagatctgcaaccccccgcaggtgcacaggcgctgcagccttctgaggaaggaatggagacagatgaggctgtatctggcatcctggaaactgaggctgctacagaatcttctaggcctccagtcaatgctcctgacccctcagccggcccaacagataccaaggaagccagaggaaatagcagtgaaacctcacactcagtgccagaagccaaagggtctaaagaagtggaagtcactcttgttcggaaagacaaagggcgccagaaaacaacccgatcacgccgcaagcgaaacacaaacaagaaagtggtggctcctgtagagagccatgtccctgaatccaaccaagctcaaggtgagagtcctgctgcaaatgaggggacaacagtacagcaccccgaagccccacaggaagaaaagcagagtgagaaaccccattccactcctcctcagtcatgtacttctgacctaagcaagattccctccacagagaattcgtcccaagaaatcagtgttgaggaaaggactccaaccaaagcatctgtgcccccagaccttcccccacctccccagccagcaccggtggatgaggagcctcaagccaggttcagggtgcattccatcattgaaagtgacccggtgaccccacccagcgatccaagcatccccatacccacactgccttctgtaactgcagcaaagctctcacctcctgtcgcctctggggggatcccacaccagagcccccctactaaggtgacagagtggatcacaaggcaggaggagccacgggctcagtctactccatctccagctcttcccccagacacaaaggcctctgatgttgacaccagctccagcaccctgaggaagattctcatggaccccaagtatgtgtctgccacaagtgtcacttccacaagtgtcaccacagccattgcagagcctgtcagtgctgccccttgcctacatgaggccccgcccccgccagttgactctaaaaagcctttagaagaaaaaacagcacctccagtgacaaacaactctgagatacaagcctcggaggtgctggtagctgctgacaaggaaaaggtggctccagtcattgctcccaaaattacctctgttattagccggatgcctgtcagcattgacctggaaaattcacagaagataaccttggcaaaaccagctcctcaaaccctcactggtctggtgagcgcactcactggcctggtgaacgtctccctggtcccggtgaatgccctgaaaggccccgtgaagggctcagtgaccacactgaaaagtttggtgagcacccctgctgggcccgtgaacgtcctgaaagggcctgtgaatgttcttacggggccagtgaatgttctcaccactccagtgaacgccacggtgggcacagtgaatgccgccccaggcacagtcaatgccgctgcgagtgcagtgaatgccacagcaagtgcagtgaccgtcacagcgggtgcggttactgctgcatctggtggtgtaacggccacaacaggcacggtgacaatggcaggggcagtgattgcgccgtcaacaaagtgcaaacagagagcgagtgctaatgaaaacagtcggttccacccagggtccatgcctgtgatcgacgatcgtccggcagacgcgggctcaggggcggggctgcgtgtgaacacttctgaaggggttgtgctcctgagttactcagggcagaagaccgaaggcccacagcggatcagcgccaagatcagccagatccccccggccagtgcaatggacattgaatttcagcagtcagtgtccaagtcccaggtcaaacctgattctgtcacagcatcgcagcctccatccaaaggccctcaagctcctgcaggctatgcgaacgtggccacccattccacgttggtactgaccgcccagacatataatgcctctcctgtgatttcgtctgtgaaggccgataggccatccttggagaagcccgagcccattcacctctcggtgtccacgcctgtcacccagggaggcacagtgaaggttctcacccaggggatcaacacaccccctgtgctggttcacaaccagctggtcctcaccccaagcattgtcaccacaaacaagaagcttgctgaccccgtcacccttaaaatcgagaccaaggtccttcagccggccaacctggggtccacgctcacgccccaccaccctcctgctctgcccagcaaactgcctacagaagtcaaccatgtcccctcggggcccagcatcccagcagatcgaactgtctcccatttggcagctgcaaagctagatgctcattctcctcgaccaagtggacccgggccatcctcattcccaagggcaagccaccccagcagtactgcatctacggcgctctccaccaacgccacagtcatgctggctgcaggcatcccagtgccccagttcatctccagcatccacccagagcagtctgtcatcatgccaccccacagcatcacccagactgtgtccctgagccacctctcccagggcgaggtgagaatgaacactcccacgctgcccagtatcacctacagcatccggccagaagcgcttcactctcctcgggctccgctgcagccccagcaaatagaggtcagggccccacagcgtgccagcaccccgcagccagccccagctggtgtgcctgcactggcctcccagcaccctcccgaggaggaagtgcattatcaccttcctgtcgctcgagccacagcccctgtgcagtcagaggtactagtcatgcagtctgagtaccgactgcacccctatactgtgccacgggatgtgaggatcatggtgcatccacatgtgacggcagtcagcgagcagcccagggccgcggatggggtggtgaaggtgccaccagccagcaaggcccctcagcagccagggaaggaagctgccaagacaccagatgccaaagctgcccccacccccacccctgcccccgtccctgtccctgtcccccttcctgcccctgctcctgcccctcatggtgaggcccgtatcctcacagttacccccagtaaccaactccaggggctgcctctgacccctcctgtggtggtgacccatggggtgcagattgtgcactccagcggggagctgtttcaagagtaccggtacggcgacatccgcacctaccaccccccggcccagctcacacacactcagtttcccgccgcttcctctgttggcctgccttcccggaccaagacagctgctcagggccctcctcctgaaggtgagcccctgcagcctcctcagcctgtgcagtccacacagcctgcccagcctgcaccaccctgcccgccctcccagctcggtcagcccggccagccaccaagcagcaagatgcctcaagtgtcccaggaggcaaaggggacccagacgggagtagagcagcctcgcctcccagctggacctgcaaacaggccacctgagcctcacacccaggttcagagggcacaagcagaaacaggcccgacttccttcccctcccctgtgtctgtctccatgaagcctgaccttccagtctctcttcccactcagactgccccaaaacagccgttgtttgtcccaacaacctctggccccagcaccccaccaggactggttctgccacacactgaattccagccagcccccaaacaagattcctctccacacctgacttcccagagacccgtggatatggttcaacttctgaagaagtaccccatcgtgtggcagggcctgctggccctcaagaatgacacagctgctgtgcagctccacttcgtctctggcaacaacgtcctggcccatcggtccctgcccctttctgaaggagggcccccactaaggatcgcccagaggatgcggctggaggcaacgcagctggaaggggttgcccgaaggatgacggtggagacagattactgtctgctgctggctctgccctgtggccgtgaccaagaggatgttgtgagccagaccgagtccctcaaggctgccttcatcacttacctgcaggccaagcaggcggcagggatcatcaacgttcccaaccctggctccaatcagcctgcctacgtgctgcagatcttcccgccctgtgagttctctgagagtcacctgtcccgcctggcccctgacctccttgccagcatctccaacatctctccccacctcatgattgtcattgcctccgtgtgagccactgagtggttatcacctcagtgaatcttcccagggctctgcagtaaaaacaaaggacaacccagccaagcagaggaagaagctgccgaaggggacagactccactgccagacggccagccgtttgctgtcctgccgcccggctcagtcggccagacttcctctaggagtggtgctgctaccttgtatgtttacataatgctttagcccaaggacacatcaccaacccatggactcgcagacaccggggctgggtttctctttcctctttttggagaaaaggaacagggcagtggaatgaaaattttttgtttgtttgtttttaagaaacaagaaaacagaactgcctttgcactaaattagtgacttggacttttgcccagtgaagacaggctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacacaccaa

SEQ ID NO: 29676 - DNA, 1733 bp, Homo sapiens
ctatatggaatatttctggaatattagagcctacagattcttttagaagttgatatctgcctctccattttcactacataaagtgtacaaacaaattggattgtaacaaaaaatctggcagaccataatgattcaaccacttggattctacaaacaatactttaacatggaaatgtgtacttggatgaagaagagagaaggcaatgcctgatttttccattttggatctacacaatttctgtattgttggaattacactctttgatggaatggggaaaaattaaaatgatggatgtttcctaaatcctggaatatagccattcttttctaattgctgggatatatgggatgtcttgctgtcaagattccactagcccagggaaagaggattactatatcatttcttaagcaagttgctgtccaatcaaaggtactttagctttgaacacatggtgatgatcagttgtggatacagcaatcaaaattgactgggctggatggctacaaaagtgaactattggcgagcaactgtgccttcctcattcgttggaattgtagaggatatttcctcttctgccagctacctgattcatacttagggctggaaatatttatgaatgtggataaatttctaattgtctgctatctcaagaaagaagtctgggggtttgagagttacagtttgtctgggactacttgcttccagtggaattattttgtctggtcactaagattttttttttcttgtggttcatctaaatatcatttgacacccttgcccattaagaaggtggattacccccataagaggggccaaaattggggaagttatgttcacaattctctccctagatttaattgggattataggtcgtgtttccacacttggaaaagggcttcagataacagggagcgtgcttatgaacatagtgcctatggacaccatgaacgggggacgggaggatttgatcggacaagacattacgatcaggattactatagagatcctcgagagcggactttacaacatgggctctattacgcttctcggagtcgaagtccaaatcgctttgatgctcatgacccccgatatgaacctagggctcgcgagcagtttacactgcccagtgtggtacacagggatatctacagggatgatattacccgggaggtacgaggcagaaggccagagcggaattaccagcacagcaggagtcggtcaccacattcatcccagtctagaaatcagtctcctcagagactggctagccaagcatctagacccacaaggtcccctagcggcagcggctctagaagtagatcctccagtagtgattcaatcagcagcagcagtagtaccagcagtgacagcagtgattccagcagtagttcaagtgatgattctccagctcgatcagttcagtctgcagcagtccctgcacccacttcccagttgctttcatctctggaaaaagatgagccccgtaaaagttttggcatcaaggtccagaatcttccagtacgctctacagatacaagccttaaagatggccttttccatgaatttaagaaatttggaaaagtaacttcagtgcagatacatggaacttcagaagagaggtatggtctggtattctttcggcagcaagaggaccaagaaaaagccttgactgcatcaaaaggaaaacttttctttggcatgcagattgaagtaacagcatggataggtccag

SEQ ID NO: 29677 - DNA, 891 bp, Homo sapiens
gccaagcatctagacccacaaggtcccctagcggcagcggctctagaagtagatcctccagtagtgattcaatcagcagcagcagtagtaccagcagtgacagtgattccagcagtagttcaagtgatgattctccagctcgatcagttcagtctgcagcagtccctgcacccacttcccagttgctttcatctctggaaaaagatgagccccgtaaaagttttggcatcaaggtccagaatcttccagtacgctctacagatacaagccttaaagatggccttttccatgaatttaagaaatttggaaaagtaacttcagtgcagatacatggaacttcagaagagaggtatggtctggtattctttcggcagcaagaggaccaagaaaaagccttgactgcatcaaaaggaaaacttttctttggcatgcagattgaagtaacagcatggataggtccagaaacagaaagtgaaaatgaatttcgccccttggatgaaaggatagatgaatttcaccccaaagcaacaagaactctctttattggcaaccttgaaaaaaccactacttaccatgaccttcgcaacatcttccagcgctttggagaaattgtggatattgacattaagaaagtaaatggagttcctcagtatgcgtttctgcaatactgtgatattgctagcgtttgtaaagctattaagaagatggatggggaatatcttggaaataatcgcctcaagctgggttttggaaagagcatgcctacaaactgcgtgtggctagatgggctttcttcgaatgtgtcagatcagtatttaacacgacatttctgccgatatgggcctgtggtaaaggtggtgtttgaccgcttaaaaggcatggccctggttc

SEQ ID NO: 29678 - DNA, 1499 bp, Homo sapiens
gtcacgggattcggagccgggcggctacgggcggggtgtcgcagctctcttcgacgtacctgtcctcaggagccgcggcggcgactgcgcctcggacggccgtcggggccgagaaccatgagccccaggggcacgggctgctccgccgggctgctgatgactgtcggctggctgcttctggcgggcctccagtccgcgcgcgggaccaacgtcaccgctgccgtccaggatgccggcctggcccacgaaggcgagggcgaggaggagaccgaaaacaacgacagcgagaccgcggagaactacgctccgcctgaaaccgaggatgtttcaaataggaatgtcgtcaaagaagtagaattcggaatgtgcaccgttacatgtggtattggtgttagagaagttatattaacaaatggatgccctggtggtgaatccaagtgtgttgtacgggtagaagaatgccgtggaccaacagattgtggctggggtaaaccaatttcagaaagtcttgaaagtgttagattggcatgtattcacacatctcccttaaatcgtttcaaatatatgtggaaacttctaagacaagaccaacaatccattatacttgtaaatgattcagcaatcctagaagtacgcaaggaaagtcaccccttggctttcgagtgtgacacactggataataatgaaatagtagcaactattaaattcacagtctatacgagcagtgaattgcagatgagaagatcaagcctaccagccactgatgcagccctaatttttgtgctgaccataggagtcattatctgtgtatttataattttcttattgatcttcataatcataaattgggcagcagtcaaggctttctggggggcaaaagcctctacacctgaggtacaatccgagcagagttctgtgagatacaaagattcaacttctcttgaccaattaccaacagaaatgcctggtgaagatgatgctttaagtgaatggaatgaatgatgtttgaatgatatataacaaaccaaaggatattacagaatattagattcattattacaaaaataaaatacacattgaaatactttaataatgttgcgatggattgccacagtgtgaaggaaatgcagtgtggggataggactattttatcagtgcatttttccagtacagttatcaaatattacttttaatttgttctcaacacttatttcaggtaatagcttggggatatttatctaaaggtacccccaacaaatcttctaagtgcatttttgatcactttgataacttcttaggtgatttgcctgttttgtcttaaataagaacaatgtaatatagaaatgctttacatattagactttctctcccctggaagcactgggttgaacttgctaaagtaaatcatactttagaatctcttcagggaatgtgacatacaaagtttgtaagacatgaagtaataacgataatgataacaataaatgcttacttagtga

SEQ ID NO: 29679 - DNA, 817 bp, Homo sapiens
ggcaaggttgtgggggacatcttgagctgaagcagggttttgagccactgctgctgctgccattgtcaccatggtctcagctctgcggggagcacccctgatcagggtgcactcaagccctgtttcttctccttctgtgagtggaccacggaggctggtgagctgcctgtcatcccaaagctcagctctgagccagagtggtggtggctccacctctgccgccggcatagaagccaggagcagggctctcagaaggcggtggtgcccagctgggatcatgttgttggccctggtctgtctgctcagctgcctgctaccctccagtgaggccaagctctacggtcgttgtgaactggccagagtgctacatgacttcgggctggacggataccggggatacagcctggctgactgggtctgccttgcttatttcacaagcggtttcaacgcagctgctttggactacgaggctgatgggagcaccaacaacgggatcttccagatcaacagccggaggtggtgcagcaacctcaccccgaacgtccccaacgtgtgccggatgtactgctcagatttgttgaatcctaatctcaaggataccgttatctgtgccatgaagataacccaagagcctcagggtctgggttactgggaggcctggaggcatcactgccagggaaaagacctcactgaatgggtggatggctgtgacttctaggatggacggaaccatgcacagcaggctgggaaatgtggtttggttcctgacctaggcttgggaagacaagccagcgaataaaggatggttgaacgtgaa

SEQ ID NO: 29680 - DNA, 744 bp, Homo sapiens
ggacctcgaaggggcagttatggtgggagccatccaaggtgtcacagggctgggcttttcatttaacaaatttgttctgatggatgtgtatagaatagcttggaagagtggttgagacatgatacaagaagaccatgaaggaagccaggatggaggggtgcactcaagccctgtttcttctccttctgtgagtggaccacggaggctggtgagctgcctgtcatcccaaagctcagctctgagccagagtggtggtggctccacctctgccgccggcatagaagccaggagcagggctctcagaaggcggtggtgcccagctgggatcatgttgttggccctggtctgtctgctcagctgcctgctaccctccagtgaggccaagctctacggtcgttgtgaactggccagagtgctacatgacttcgggctggacggataccggggatacagcctggctgactgggtctgccttgcttatttcacaagcggtttcaacgcagctgctttggactacgaggctgatgggagcaccaacaacgggatcttccagatcaacagccggaggtggtgcagcaacctcaccccgaacgtccccaacgtgtgccggatgtactgctcagatttgttgaatcctaatctcaaggataccgttatctgtgccatgaagataacccaagagcctcagggtctgggttactgggaggcctggaggcatcactgccagggaaaagacctcactga

SEQ ID NO: 29681 - DNA, 508 bp, Homo sapiens
ggcaaggttgtgggggacatcttgagctgaagcagggttttgagccactgctgctgctgccattgtcaccatggtctcagctctgcggggagcacccctgatcagggtctgccttgcttatttcacaagcggtttcaacgcagctgctttggactacgaggctgatgggagcaccaacaacgggatcttccagatcaacagccggaggtggtgcagcaacctcaccccgaacgtccccaacgtgtgccggatgtactgctcagatttgttgaatcctaatctcaaggataccgttatctgtgccatgaagataacccaagagcctcagggtctgggttactgggaggcctggaggcatcactgccagggaaaagacctcactgaatgggtggatggctgtgacttctaggatggacggaaccatgcacagcaggctgggaaatgtggtttggttcctgacctaggcttgggaagacaagccagcgaataaaggatggttgaacgtgaa

SEQ ID NO: 29682 - DNA, 888 bp, Homo sapiens
ggacctcgaaggggcagttatggtgggagccatccaaggtgtcacagggctgggcttttcatttaacaaatttgttctgatggatgtgtatagaatagcttggaagagtggttgagacatgatacaagaagaccatgaaggaagccaggatggaggggtgcactcaagccctgtttcttctccttctgtgagtggaccacggaggctggtgagctgcctgtcatcccaaagctcagctctgagccagagtggtggtggctccacctctgccgccggcatagaagccaggagcagggctctcagaaggcggtggtgcccagctgggatcatgttgttggccctggtctgtctgctcagctgcctgctaccctccagtgaggccaagctctacggtcgttgtgaactggccagagtgctacatgacttcgggctggacggataccggggatacagcctggctgactgcctatgctctgccctatgcaggggtctgccttgcttatttcacaagcggtttcaacgcagctgctttggactacgaggctgatgggagcaccaacaacgggatcttccagatcaacagccggaggtggtgcagcaacctcaccccgaacgtccccaacgtgtgccggatgtactgctcagatttgttgaatcctaatctcaaggataccgttatctgtgccatgaagataacccaagagcctcagggtctgggttactgggaggcctggaggcatcactgccagggaaaagacctcactgaatgggtggatggctgtgacttctaggatggacggaaccatgcacagcaggctgggaaatgtggtttggttcctgacctaggcttgggaagacaagccagcgaataaaggatggttgaacgtg

SEQ ID NO: 29683 - DNA, 971 bp, Homo sapiens
ttccattcacagactcttgttgggcagcagccacccgctcacctccatccccaggacttagagggacgcagggcgttgggaacagaggacactccaggcgctgaccctgggaggccaggaccagggccaaagtcccgtgggcaagaggagtcctcagaggtccttcattcagcggttccgggaggtctgggaagcccacggcctggctggggcagggtcaacgccgccaggccgccatggtcctgtgctggctgctgcttctggtgatggctctgcccccaggcacgacgggcgtcaaggactgcgtcttctgtgagctcaccgactccatgcagtgtcctggtacctacatgcactgtggcgatgacgaggactgcttcacaggccacggggtcgccccgggcactggtccggtcatcaacaaaggctgcctgcgagccaccagctgcggccttgaggaacccgtcagctacaggggcgtcacctacagcctcaccaccaactgctgcaccggccgcctgtgtaacagagccccgagcagccagacagtgggggccaccaccagcctggcactggggctgggtatgctgcttcctccacgtttgctgtgaccaacagggaggacagggcctgggactgttctcccagatccgccactccccatgtccccatgtccttcccccactaaatggccagagaggccctggacaacctcttgcggccctggcttcatcccttctaaggctgtccaccaggagcccggtgctaggggaagcatccccaggcctgactgagcggcaggggagcacggcccgtgggtttgattgtattactctgttccactggttctaagacgcagagcttctcacatctcaatcaggatgcttctctccattggtagcactttagagtccatgaaatatggtaaaaaatatatatatatcataataaatgacagctgatgttcatgg

SEQ ID NO: 29684 - DNA, 732 bp, Homo sapiens
ggcagcaacagagttgcaggtgtaaaataacgggaaggcgggatgcgtggctaaattgctctgcgtgcacaaagagtaggagagcccagagttccagaatgcccctaattccgaacaccacagggtgagtctggagcaagtcacctgggagggcttacaggtgccataatgaaggcctggggcactgtggtagtgaccttggccacgctgatggttgtcactgtggatgccaagatctatgaacgctgcgagctggcggcaagactggagagagcagggctgaacggctacaagggctacggcgttggagactggctgtgcatggctcattatgagagtggctttgacaccgccttcgtggaccacaatcctgatggcagcagtgaatatggcattttccaactgaattctgcctggtggtgtgacaatggcattacacccaccaagaacctctgccacatggattgtcatgacctgctcaatcgccatattctggatgacatcaggtgtgccaagcagattgtgtcctcacagaatgggctttctgcctggacttcttggaggctacactgttctggccatgatttatctgaatggctcaaggggtgtgatatgcatgtgaaaattgatccaaaaattcatccatgactcagattcgaagagacagattttatcttcctttcatttctttctcttgtgcatttaataaaggatggtatctataaacaatgc

SEQ ID NO: 29685 - DNA, 571 bp, Homo sapiens
tgccataatgaaggcctggggcactgtggtagtgaccttggccacgctgatggttgtcactgtggatgccaagatctatgaacgctgcgagctggcggcaagactggagagagcagggctgaacggctacaagggctacggcgttggagactggctgtgcatggctcattatgagagtggctttgacaccgccttcgtggaccacaatcctgatggcagcagtgaatatggcattttccaactgaattctgcctggtggtgtgacaatggcattacacccaccaagaacctctgccacatggattgtcatgacctgctcaatcgccatattctggatgacatcaggtgtgccaagcagattgtgtcctcacagaatgggctttctgcctggacttcttggaggctacactgttctggccatgatttatctgaatggctcaaggggtgtgatatgcatgtgaaaattgatccaaaaattcatccatgactcagattcgaagagacagattttatcttcctttcatttctttctcttgtgcatttaataaaggatggtatctataaacaatgc

SEQ ID NO: 29686 - DNA, 3948 bp, Homo sapiens
agaagcagaaaaggttggataaaagataaggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccactgccggagccatctcggagctcacggagagccgcctgaggagcggcacaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtggagctggacagaatatttctgtccataagacccccagaagtcccctaagtgggataccagtgaggactgctccagcagctgctgtctctccaatgcagaggcattcgacttacagcagtgtgcggccagccagcagaggggtgactcaacgcttggaccttcctgaccttcccctctcagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcagtgtggaaagaaaagaccctctggcagccttggcccgggaatacggtggttccaagcgcaatgctctactgaaatggtgccagaagaagacacaaggttatgcgaacattgacatcaccaatttcagcagcagctggagcgatggcctggccttctgtgctctgctccacacctacctgcctgcccacatcccctaccaggagctgaatagtcaggagaaaaagaggaatctcttgttggcatttgaagcggctgaaagtgtaggcatcaaacccagcctggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaacaacaaaacacaaaaaataaacatttgttccagggcaacctggaaa

SEQ ID NO: 29687 - DNA, 4799 bp, Homo sapiens
ctggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccgtgagtctgctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaagtacaagtcttatgaaaagttatttgcagctggagtgctgaaaagggcacagtggcagagcagatgcagagctgggtacagcgcaggcccgagttcttttgttttttgttgttgttgttgttgttgttttgttttgttttttttttttttttgagacagagtttcactcttgttgcccaggctggagtgcaatggtacgatctcggctcactgcaacctctgcctcccgggttcaagtgattctcttgcctcagccttccaagtagctggaattacaggcgcctgccaccacacccagctaatttttgtattgttagtagagatggggtttcaccgtgttggccaggctgctcttgaactcctgacctcaggtgatccccacctcagcctcccaaagtgctgggattacagacatgagccaccgcacccagaacctaaggcccaagttctactttttggtgttcatttctctgcttccttttgatcgtggtgtctgatcatcttggaattcacattactcaaggcaaaataggaagccatctgcgtgatgtcacattccgaagaagtcagaaggttcggcgagttggagctttactcttgttgcccaggctagagtgcagtggtgcgatcttggctcattgcaagctccgcttcctgggtttaagctattctcctgccttggcctcccaagtagctgggattacaggcatgtgccgtcactcctggctaattttgtatttttagtagagatgcaatttcaccatgttggtcaggctggtctcgaactcctgacctcaagtgatctggccgcctcagcctcccaaagtgctgggattacaggcttgagaccccatgtctggccccttctgtggggtcttgattgagccccttcacttggagtctgacttcattacctcgtctgaaacaaggtgcctccaagctttgggttgatttccagaatcttgttgggttaaacataagtagaagtttgatcataaaggatgttattaagccggataggtaagcacggtgacaatggcaatagaaatctaatggaaaacgattgaatgacaactacaccaaagtttcatggatgaaactcaccccagaaacttagtgttcaaatcagagtgatacacaattcaaaatgtgattttaaacttctggaaatatgtgtgtttgtgaagatccaaatccaattcagcaacctccatcaggcagaaaccttctgcaatcctcacatgaggaactggttcacagtgtacacagcatggagccattagtgacgttatccaaaggatgagacaagacaaaagttactgtctaataaaaggaaaattaggaacaggaatgctctttaaactcaggaagatcttttggggtgtcaaactggacagcacagaatcattagaaaaattagcttggcgtgagaagagacattgaggtcttctctgtaaaatttacttagatacttgtgaataggactgaaatttatattttgggcactctttacctcagattcagagttcttaggattatttaaaattcatttgctggatgttttcaagtataaacaataagaaaactgcaacttcaacttaaaaggcactgctgtatttgcaccctatattttgacctgtcgttaggtactgttgaatatttttatctgtaagcatttatgaagtgcaaaataaacatgttattatatagaagcgtctgctgcttagttttaatcaccagctacgtttctgcagggcctttatgtcgttttgttctacatttttttctgaatacagtttcagaacttcaaagtcacatcaagtaactagaatttgaggtagaaaaaagctggatgtaagttgtaaataggaggttgacatggaatatgaacagtttcattagtagaacaaaagggcatggagtaaaaatgctaattttgcataaatttttaaaactctagggtctcagaaaatatagcatggacttaaagtctagatgtgttttgttgacatttaaatatgaatagattgatgatttaatgtattggattttttcttaattatgaagtattatttaggtatactaataacaaaatggagacgtgtgaagaaaaatattaatctttcttctccctcagtaccacctgtgaggaaatcagtgttaacagtgtgtacatttttctttactcatgaatatgtatagggttcattttcatatttttaataaaaattggattatattcttttca

SEQ ID NO: 29688 - DNA, 2525 bp, Homo sapiens
cggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctg

SEQ ID NO: 29689 - DNA, 3747 bp, Homo sapiens
ctggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtggagctggacagaatatttctgtccataagacccccagaagtcccctaagtgggataccagtgaggactgctccagcagctgctgtctctccaatgcagaggcattcgacttacagcagtgtgcggccagccagcagaggggtgactcaacgcttggaccttcctgaccttcccctctcagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcagtgtggaaagaaaagaccctctggcagccttggcccgggaatacggtggttccaagcgcaatgctctactgaaatggtgccagaagaagacacaaggttatgcgaacattgacatcaccaatttcagcagcagctggagcgatggcctggccttctgtgctctgctccacacctacctgcctgcccacatcccctaccaggagctgaatagtcaggagaaaaagaggaatctcttgttggcatttgaagcggctgaaagtgtaggcatcaaacccagcctggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaacaacaaaacacaaaaaataaacatt

SEQ ID NO: 29690 - DNA, 4969 bp, Homo sapiens
gaagcagaaaaggttggataaaagataaggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccactgccggagccatctcggagctcacggagagccgcctgaggagcggcacaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaagtacaagtcttatgaaaagttatttgcagctggagtgctgaaaagggcacagtggcagagcagatgcagagctgggtacagcgcaggcccgagttcttttgttttttgttgttgttgttgttgttgttttgttttgttttttttttttttttgagacagagtttcactcttgttgcccaggctggagtgcaatggtacgatctcggctcactgcaacctctgcctcccgggttcaagtgattctcttgcctcagccttccaagtagctggaattacaggcgcctgccaccacacccagctaatttttgtattgttagtagagatggggtttcaccgtgttggccaggctgctcttgaactcctgacctcaggtgatccccacctcagcctcccaaagtgctgggattacagacatgagccaccgcacccagaacctaaggcccaagttctactttttggtgttcatttctctgcttccttttgatcgtggtgtctgatcatcttggaattcacattactcaaggcaaaataggaagccatctgcgtgatgtcacattccgaagaagtcagaaggttcggcgagttggagctttactcttgttgcccaggctagagtgcagtggtgcgatcttggctcattgcaagctccgcttcctgggtttaagctattctcctgccttggcctcccaagtagctgggattacaggcatgtgccgtcactcctggctaattttgtatttttagtagagatgcaatttcaccatgttggtcaggctggtctcgaactcctgacctcaagtgatctggccgcctcagcctcccaaagtgctgggattacaggcttgagaccccatgtctggccccttctgtggggtcttgattgagccccttcacttggagtctgacttcattacctcgtctgaaacaaggtgcctccaagctttgggttgatttccagaatcttgttgggttaaacataagtagaagtttgatcataaaggatgttattaagccggataggtaagcacggtgacaatggcaatagaaatctaatggaaaacgattgaatgacaactacaccaaagtttcatggatgaaactcaccccagaaacttagtgttcaaatcagagtgatacacaattcaaaatgtgattttaaacttctggaaatatgtgtgtttgtgaagatccaaatccaattcagcaacctccatcaggcagaaaccttctgcaatcctcacatgaggaactggttcacagtgtacacagcatggagccattagtgacgttatccaaaggatgagacaagacaaaagttactgtctaataaaaggaaaattaggaacaggaatgctctttaaactcaggaagatcttttggggtgtcaaactggacagcacagaatcattagaaaaattagcttggcgtgagaagagacattgaggtcttctctgtaaaatttacttagatacttgtgaataggactgaaatttatattttgggcactctttacctcagattcagagttcttaggattatttaaaattcatttgctggatgttttcaagtataaacaataagaaaactgcaacttcaacttaaaaggcactgctgtatttgcaccctatattttgacctgtcgttaggtactgttgaatatttttatctgtaagcatttatgaagtgcaaaataaacatgttattatatagaagcgtctgctgcttagttttaatcaccagctacgtttctgcagggcctttatgtcgttttgttctacatttttttctgaatacagtttcagaacttcaaagtcacatcaagtaactagaatttgaggtagaaaaaagctggatgtaagttgtaaataggaggttgacatggaatatgaacagtttcattagtagaacaaaagggcatggagtaaaaatgctaattttgcataaatttttaaaactctagggtctcagaaaatatagcatggacttaaagtctagatgtgttttgttgacatttaaatatgaatagattgatgatttaatgtattggattttttcttaattatgaagtattatttaggtatactaataacaaaatggagacgtgtgaagaaaaatattaatctttcttctccctcagtaccacctgtgaggaaatcagtgttaacagtgtgtacatttttctttactcatgaatatgtatagggttcattttcatatttttaataaaaattggattatattcttttca

SEQ ID NO: 29691 - DNA, 8196 bp, Homo sapiens
gcgctcgccccctggcggcgatggctggaggcgccggcggagcgcgggtccctctcctgagcatcagtgagcgcccggagccgtggccgctgggggttgcggcggcgctgagccagcggggccggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccactgccggagccatctcggagctcacggagagccgcctgaggagcggcacaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtggagctggacagaatatttctgtccataagacccccagaagtcccctaagtgggataccagtgaggactgctccagcagctgctgtctctccaatgcagaggcattcgacttacagcagtgtgcggccagccagcagaggggtgactcaacgcttggaccttcctgaccttcccctctcagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcagtgtggaaagaaaagaccctctggcagccttggcccgggaatacggtggttccaagcgcaatgctctactgaaatggtgccagaagaagacacaaggttatgcgaagaggaatctcttgttggcatttgaagcggctgaaagtgtaggcatcaaacccagcctggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaacaacaaaacacaaaaaataaacatttgttccagggcaacctggaaacgtgcgtgcgcactcagccttttggggaaaaatgggagttctaggtaacaatgttaacacctggaacttgattcacttttagctctcaccatcccttatttgatttattgtagcaaaaggaaagcctgtgagaatgcaagggagcccctggctgctttgctggagtccctgggaggtgccccacacctctgccaccaaagtctgtgtgctcctgagcagctcgcggctttcacagtagggaaaccgcagtcctcgtcacctgcgcctttgtcctcccattcgtttaccctcccgttcacatccacacaggcttgtaccccacagaacttgacaggaggtcacatgtgtgaatggcctgtgtctgctttacagggttgagcaggctgagggtgtgtgcctctggggatgctgggctgacagcaaatcccaacagtatttcggctctggactgatttggcctttagtgcttccccaggcctctttcatcggcatgggaaaagcccttaggggtgggcggtgagggcacatttataactaacaaagaagaatgcagttgccccagcatcctactggtcaccttaagtggcagcagagccctccccagcggtgccccagtccctcagaagtgctcagtccggcccgagtgcccatctggtggctctgccgtgttcttctgggcggatctgtgtgcactacacagcgagtgagggcgtggctcacacagttgtttgagggaaatgggtaatgcccatcccttgctgttttaagtgccaaatagcgtgttagcgcccctccaacaaaggatcatccttccagtgagtcaccgagaatgacagtgactgccattactattcaaagtacatctctgattgctgatctgagccactggttcagagccaggttctagaggctgcaggtccagccccttaccattcctggagaggtaggagctcagtcccttcctccaagccagacctttgcagaggtggcaactgggctgcacgggtcagcagatccctgattctcaagccaccttgagacaagaactccgcccccctgttagtgcatcccagctgcagctctgcatcagaacctacagtggacccttttgaaaacactcttggctgccctagttggttaacttcagaatgtctggaatgggaccagagatgcagttcacatgttttgtaagttctttaggcgactgaagcacagctgcttggagaaccactgaggggtggacaccttcccctggcagccacaaggcaggcagcctgcgggagctcctgagcagctgttgggcgatggtcattacatcacccatgcctttgtatttaaatgaaactcgacacatagaaccaattcaacctgaaagttactacttctgctgattcaggcacttgtttgaagcattttttttttattaaccctgtacttcttctttgcccaccattaaagtgggggaaagtaatatcccaagtagttgagttgagctgttggttgttagatttaagctggaattagtccagggttttatgtggggaggcagttgctgtcttgggatacccggagtgggagtgggtgttttctgtgattggttctgttttttatttttacttatttattttgagatggagtttcatccttattgcccaggctggagggcaatagcaccgtctcagctcactgcaacctccgccgcccgtgtttaagcgattctcctgcctcagcctcccatgtggctgggattacaggtgcccatcaccacacccagctaatgtttttgtatttttagtaaagagggggtttcaccatgttggcccggctggtctcgaactcctgatggcaaggtgatctgcctgcctcagcctcccaaagtgctgggattacaggcatgagccactgagcccggctgtttttttgtgttttttttgttgttgtttgtttgtttttttttttgagacagagtcttgctctgtcgcccaggctggagtgccagtggcgcgatttcagctcactcaggagtgagccaccacacctggcctgtgattggctctattttgagtgattacgtgtaaatcatctagaaccagctctgagcaatggcgttgcggtgtccctccctccccgctggggccataccagcccctctccactgggagcccaagttgccaatgactgtggccaaactcccccatttttgtctgtatcctgctctctttaggttaaaaagaaggaaagaaacatgaaaggccatgtacaatttatttttacaactccaggagtttccccgactaccattttttttttttttatttgccagtggtgtgcatgtagaagaggaatgccatgtcctgtccatagaaatacacatggtggtcaggcatggtggctcatgcctataatcccagcactttgggaggctgaggtgggaggattgcttgagcccaggagtttgagaccagcctgggcaacatggcaagacctctgactctataaaaaaatttttttttttttttttttttgagagagcgtctcacttctctgtcacccaggctagagtagtgtgatcttggcttattacaacttccgcctcccaggttcaagagattctcctgccttagcctcctaagtagctgggattataggcacatgccaccatgcctggcatatttttgtatttttagtagaaacagtttcaccatgttggccaggctggtcttgaactcctgacctcaagtgataagcctgcctcaacctcccaaagtgctgggactacaggggtaagccaccgcgcctggcccaaaattttgttttttaattagctgggtacaatgataggcacctgtaatctcagctgcttgggaggctgaggtgggagcatcacttgagcccaggagtttgaggctgcagtaagctgtgtttgtgccactgcactctggcctgggccaaagagcaagaccctgtcacacacacacacaaaaaaaagaaatacaggtggtgttttggggaagggaaggttctgctggggtcctggaactgtgactgatggcctcaggagtccaggaataggccttctagcacagcagctagtagggctcccccaagccatccgctggcgtgtggaggtgcaggacctgggggaggcagtccccaacccagctaggccaaggggtagggtttttaggtctgtttttaacagagctcagagcaccaggtgaaggtggaaagttggcaggaaaacaaggtcagcatcttattttttctatactcagcagagtgtgccattcccagtttctgtcctgaggatttcaaagaccacaacagccacatttctttccatcttccctcagccagtagtcatttaaaattcttcagttgttctgaagatcctttttttaatgtatcatttttacatgaaagacagctgcaaaatgcaagccccagtagagttggagagtttttcaaggtgagaagtcgctgttctctgcattgaacatggattgaattttccttgtctgatggtaacccatggcccccgccctgcggggataacattctcaggagcttctcttgtcctagccccttctcatttcaaaaatattagtcttttattttcctttttcattcagtttttgttttacagcttttgtagagaccaacccaagtagatgcaggtgggtgttagataaaaacacacatccccaggggacaagccatccagcggtgaggaatctctgccatgttctcttccctgctgcccacaaacgttacggagactcccttagcctccccctcctcttccccactgaggggcagcttgtggagatggaggactcgggcccatagatgcagaccccctaccaaatctagcaatagttctcacccttccaaagctcgagtgccattttgagatgacctaccaatgacatgcagtaaaggacataacctcacagcctttttagaagcatttcgaatatctacagttgcctcaattcacggggcatttcactcctctgatccaggttagaattttgctaaatctgtagcatcctgaatagcacactaatttttttttttagcacactaactttaactacattagttgagtgtagttgatacatctgtggcctcgtgtctataaagagcacactagattgtacccagcacttttggatatgacatgctaattagatgtatttaactattcataggaaagtgtatgataaatgactgtaatatttctaataaatatattttgtttctaatta

SEQ ID NO: 29692 - DNA, 324 bp, Homo sapiens
aatagagtggctgacttgctgattgaggtcggcagctcccgagaagcaggagaagcagagtttttgcagacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccactg

SEQ ID NO: 29693 - DNA, 1725 bp, Homo sapiens
cctttctttgactggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtggagctggacagaatatttctgtccataagacccccagaagtcccctaagtgggataccagtgaggactgctccagcagctgctgtctctccaatgcagaggcattcgacttacagcagtgtgcggccagccagcagaggggtgactcaacgcttggaccttcctgaccttcccctctcagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcagtgtggaaagaaaagaccctctggcagccttggcccgggaatacggtggttccaagcgcaatgctctactgaaatggtgccagaagaagacacaaggttatgcgaacattgacatcaccaatttcagcagcagctggagcgatggcctggccttctgtgctctgctccacacctacctgcctgcccacatcccctaccaggagctgaatagtcaggagaaaaagaggaatctcttgttggcatttgaagcggctgaaagtgtaggcatcaaacccagcctggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattgggga

SEQ ID NO: 29694 - DNA, 6269 bp, Homo sapiens
ggaggccgggcggcccggcaagcggcgctgcggggtaggctgctttcctgaggccggactcaacgggtctcggctgagccaccgggtgagctcaccgcccagcccaaaccaggagattgcgagggagcgatgcggtgcagcgcgtgttcttggggaagatcccgactaagccattttccagtggcacctcttccatcatgagttcctgaggcagtccgatggggctactttattccagaacaatcacaatttgcttgtaaatgcatcacgaagaggcagcccagaatgaagaaagcaagcaggagtgttggctcagtgcctaaagtgtctgcaataagtaaaacgcaaacagcagaaaaaattaaacctgaaaacagctcttcagcatctacgggaggcaaacttgtaaaacctggaacagcagcatcattgtcaaagaccaagagcagtgatgaccttttagctggaatggccggaggggtaacggtgactaatggtgttaaaggaaagaaaagcacctgcccatctgcagcaccttcagcatctgcccctgccatgaccaccgtggagaacaaatccaagattagcacaggcacagcttcttcaaccaagcggagcacttctacaggtaataaagaatccagttctactagagaaagattacgtgaacgtacccgattaaaccagagcaaaaaactaccttctgcaggtcagggagctaatgacatggcattggccaaacgttcccgcagtcgaactgctacagaatgtgacgttcgtatgagcaagtctaagtcagacaatcagatcagtgacagagctgctttggaggccaaagtgaaggatcttctcacgctggcaaaaaccaaagacgtagaaattttacatttgagaaatgaactgcgagacatgcgtgcccagctgggcattaatgaggatcattctgagggtgatgaaaaatctgagaaggaaactattatggctcaccagccgactgatgtggagtccactttattgcagttgcaggaacagaatactgccatccgtgaagaactcaaccagctgaaaaatgaaaacagaatgttaaaggacaggttgaatgcattgggcttttccctagagcagaggttagacaattctgaaaaactgtttggctatcagtccctgagcccagaaatcacccctgataaccagagcgatggaggaggaactctgacttcttcagtggaaggctctgcccctggctcagtggaggatctcttgagtcaggatgaaaatacactaatggaccatcagcacagtaactccatggacaatttagacagtgagtgcagtgaggtctaccagcccctcacatcgagcgatgatgcgctggatgcaccatcctcctcagagtcggaaggcatccccagcatagagcgctcccggaaggggagcagcgggaatgccagtgaagtgtccgtggcttgcctgactgaacggatacaccagatggaagagaaccaacacagtacaagtgaggaactccaggcaaccctgcaagagctagctgatttacagcagattacccaggaactgaatagtgaaaacgaaaggcttggagaagagaaggttattctgatggagtctttatgtcagcagagcgataagttggaacactttagtcgacagattgaatacttccgctctcttctagatgagcatcacatttcttatgtcatagatgaagatgtaaaaagtgggcgctatatggaattagagcaacgttacatggacctcgctgagaatgcccgttttgaacgggagcagcttcttggtgtccagcagcatttaagcaatactttgaaaatggcagaacaagacaataaggaagctcaagaaatgataggggcactcaaagaacgcagtcaccatatggagcgaattattgagtctgagcagaaaggaaaagcagccttggcagccacgttagaggaatacaaagccacagtggccagtgaccagatagagatgaatcgcctgaaggctcagctggagaatgaaaagcagaaagtggcagagctgtattctatccataactctggagacaaatctgatattcaggacctcctggagagtgtcaggctggacaaagaaaaagcagagactttggctagtagcttgcaggaagatctggctcatacccgaaatgatgccaatcgattacaggatgccattgctaaggtagaggatgaataccgagccttccaagaagaagctaagaaacaaattgaagatttgaatatgacgttagaaaaattaagatcagacctggatgaaaaagaaacagaaaggagtgacatgaaagaaaccatctttgaacttgaagatgaagtagaacaacatcgtgctgtgaaacttcatgacaacctcattatttctgatctagagaatacagttaaaaaactccaggaccaaaagcacgacatggaaagagaaataaagacactccacagaagacttcgggaagaatctgcggaatggcggcagtttcaggctgatctccagactgcagtagtcattgcaaatgacattaaatctgaagcccaagaggagattggtgatctaaagcgccggttacatgaggctcaagaaaaaaatgagaaactcacaaaagaattggaggaaataaagtcacgcaagcaagaggaggagcgaggccgggtatacaattacatgaatgccgttgagagagatttggcagccttaaggcagggaatgggactgagtagaaggtcctcgacttcctcagagccaactcctacagtaaaaaccctcatcaagtcctttgacagtgcatctcaagtaccaaaccctgctgcagctgcaattcctcgaacgcccctgagcccaagtcctatgaaaacccctcctgcagcagctgtgtcccctatgcagagacattccataagtggaccaatctcaacatccaaacccctgacagccctgtcagataagagaccaaactatggggaaatccctgttcaagagcatctgttaagaacatcttcagccagccggcctgcttccctgccaagagtgcctgcgatggaaagtgccaagaccctctcagtgtctcgacgaagtagtgaagaagtgaaacgggacatttctgcacaggagggagcgtcgccagcctctctgatggctatgggaaccacgtctccacagctttccctgtcctcttctccaacggcatctgtgactcccaccacccgaagccgaataagagaagaaaggaaagaccctctctcagcattggccagagaatatggaggatcaaagaggaacgccttgctgaagtggtgtcagaagaaaacagaaggctatcagaatattgacattacaaacttcagcagcagctggaatgatgggctggccttctgtgccctcctgcatacatatctccctgcccacattccatatcaagaactgaacagccaggataagagaaggaacttcatgctggctttccaggcagctgaaagtgtcggcatcaaatccacactggacattaatgaaatggtacggactgaacgacccgactggcagaacgtgatgctgtatgtgacggcgatctacaagtactttgagacctgagcatgccgggaggagccgccccaatagcgggggtacccctccacagcgaccgagcgacaccgacgccattagctacgcacccctgtaaagcttccagcaactctgggctgccccacagcgtgtgagcctccagctcggggcttccgtattggaagaactcagccgtgtggcccacagctcccaccagggcccctcccacatgacccgtccattcaggtcatgtgggctcagcacacatcctgcaggccggtggctgctggagttttccttctgaagagaatattgaactacactagtgctccagggcaccaaacaaaaagggctcatgcacagctgaatttgggaaaagggattcagttctgtgggaaactcactagggttgatgaaggctcggccgcggcacttcctgactattggctggggtgggttccggtgctggtgagaacccagaaggagagtcagcgcctggcagttcccagcgccctgggcccttcaccgtcctagtttggaggagcatgttcaccacagacgtgggtcagctgccccacacctgacggggctgtcccggccgacacaatccaggcgtgttcagcctgagctaggagagtatctagagggcgtggtgcgggcacgccagggctggggtgctgctgctgcactcacgcggctgggctttctggcgggaagcagttacgggggccccttgcctggactcagcgacctgtcttccagcctggaaggggtttggagtcccagctctggctttagatttcttcatcataaggagtttttctagttaacatttttgttttgttacgagcaatgctggaaaaggtcgctcctgttctgttagtaccaaagttacattgtttcaataagcatagaaatctaaacaacatctgtacattagcatggtgagagcaaggaataaagcaggaaataggagaaaagtaaacaactttagggagcccaggcagtgtcatttaaactcactgagtcactaagacataattctcctaggccagagttaaagaaagtgccttaactcttcttgtgagggcagccactgccctccgtggccaaggcaggacctccaagactcagtggttgagttgtctcctaccaccatgcccgccctccccaggtactgggtccatgccccctgtgcccaccctccccaggtgctgggtccatgctgtttgaaccaaagccttatttaaaggtggtcactggagatgctctcaggccagaactcaacagctatttttgggaatagggatctcccgtgtgcctaacgcagtagctattggtttgaacaatgtccagacaagacctgtacctttgagaatataactgtgtttggcacctgcatagcaccatgaggaagaccagccaccagtggaagcggggtcactgccccacagactggatgcaatgaggggctcacaggaggcccagccagcccgattgtgggctgaggggtctgcattcaagcacgatgttctagaataggagtttaacgtgtctacgtaacctagaatgtggttattaggaaaggggctgtgcatgtgggtgcagctggcggcacacctggtcaccagatggccagaagctgcccatcagccctgcccagatgtcagcctgggagctcaggctgctgccgctggctggatgccctttggtgaaatgcctgttttcagctaagaaaggagaggccaggcaagcaaagtcatgccacaaagcatatcagagacccccgcagactcctggccccgtcccgccccctgtctgagttgtgtttttgttgctgttcctctgttgatggccagctctgctgttggcatgagccactgatgttcatgtgagaattactgtttttaagtgtctctccacttaggtgtcctcagttcccacttttgctctcatttgccttcacagaggccactccacctgtccggatccagctgtctggtcatggtttggtttatttattttgtccttcaggggctgttttgccctaagaatgagggggcttcccctggtctgcagttcccaactttatcccttgctggccatgcgagcccagccctggtgcctcatgggatgggggggtaggggtccccaggatcttctggaggaaggtggccatggatggatgggctgtatctgtgttttccctctgggagtctcatgggtccagcatcaggcctgaggtcagcaacagggaaagagggtgggcacggggagggcttggccccgcctatctagaggcttgcctcgggcccctccttggggaaggtttgcgtgcagagctgcaagggagagggttccagaagcattgccttttgcctcgtctaataggatccttaggacactgtgggctttaggaatgactatagatgctcacacgtgtttaaagtgacatttggagatgctctcagtcctgtggcatctggcacgaagtctccaagaagccactttgcctcttctcccttcaagcacaagctttactgcaaaagggccagtcgcgtttctatttctctcgatcccaggcttctgcggaccgacgatacgtttaaatgttgttctagtaaatattcttgaatgtattaaaatggctgaaacaacaa

SEQ ID NO: 29695 - DNA, 3043 bp, Homo sapiens
ggccaagggcggggcccgcgagggaggccgggcggcccggcaagcggcgctgcggggtaggctgctttcctgaggccggactcaacgggtctcggctgagccaccgggtgagctcaccgcccagcccaaaccaggagattgcgagggagcgatgcggtgcagcgcgtgttcttggggaagatcccgactaagccattttccagtggcacctcttccatcatgagttcctgaggcagtccgatggggctactttattccagaacaatcacaatttgcttgtaaatgcatcacgaagaggcagcccagaatgaagaaagcaagcaggagtgttggctcagtgcctaaagtgtctgcaataagtaaaacgcaaacagcagaaaaaattaaacctgaaaacagctcttcagcatctacgggaggcaaacttgtaaaacctggaacagcagcatcattgtcaaagaccaagagcagtgatgaccttttagctggaatggccggaggggtaacggtgactaatggtgttaaaggaaagaaaagcacctgcccatctgcagcaccttcagcatctgcccctgccatgaccaccgtggagaacaaatccaagattagcacaggcacagcttcttcaaccaagcggagcacttctacaggtaataaagaatccagttctactagagaaagattacgtgaacgtacccgattaaaccagagcaaaaaactaccttctgcaggtcagggagctaatgacatggcattggccaaacgttcccgcagtcgaactgctacagaatgtgacgttcgtatgagcaagtctaagtcagacaatcagatcagtgacagagctgctttggaggccaaagtgaaggatcttctcacgctggcaaaaaccaaagacgtagaaattttacatttgagaaatgaactgcgagacatgcgtgcccagctgggcattaatgaggatcattctgagggtgatgaaaaatctgagaaggaaactattatggctcaccagccgactgatgtggagtccactttattgcagttgcaggaacagaatactgccatccgtgaagaactcaaccagctgaaaaatgaaaacagaatgttaaaggacaggttgaatgcattgggcttttccctagagcagaggttagacaattctgaaaaactgtttggctatcagtccctgagcccagaaatcacccctgataaccagagcgatggaggaggaactctgacttcttcagtggaaggctctgcccctggctcagtggaggatctcttgagtcaggatgaaaatacactaatggaccatcagcacagtaactccatggacaatttagacagtgagtgcagtgaggtctaccagcccctcacatcgagcgatgatgcgctggatgcaccatcctcctcagagtcggaaggcatccccagcatagagcgctcccggaaggggagcagcgggaatgccagtgaagtgtccgtggcttgcctgactgaacggatacaccagatggaagagaaccaacacagtacaagtgaggaactccaggcaaccctgcaagagctagctgatttacagcagattacccaggaactgaatagtgaaaacgaaaggcttggagaagagaaggttattctgatggagtctttatgtcagcagagcgataagttggaacactttagtcgacagattgaatacttccgctctcttctagatgagcatcacatttcttatgtcatagatgaagatgtaaaaagtgggcgctatatggaattagagcaacgttacatggacctcgctgagaatgcccgttttgaacgggagcagcttcttggtgtccagcagcatttaagcaatactttgaaaatggcagaacaagacaataaggaagctcaagaaatgataggggcactcaaagaacgcagtcaccatatggagcgaattattgagtctgagcagaaaggaaaagcagccttggcagccacgttagaggaatacaaagccacagtggccagtgaccagatagagatgaatcgcctgaaggctcagctggagaatgaaaagcagaaagtggcagagctgtattctatccataactctggagacaaatctgatattcaggacctcctggagagtgtcaggctggacaaagaaaaagcagagactttggctagtagcttgcaggaagatctggctcatacccgaaatgatgccaatcgattacaggatgccattgctaaggtagaggatgaataccgagccttccaagaagaagctaagaaacaaattgaagatttgaatatgacgttagaaaaattaagatcagacctggatgaaaaagaaacagaaaggagtgacatgaaagaaaccatctttgaacttgaagatgaagtagaacaacatcgtgctgtgaaacttcatgacaacctcattatttctgatctagagaatacagttaaaaaactccaggaccaaaagcacgacatggaaagagaaataaagacactccacagaagacttcgggaagaatctgcggaatggcggcagtttcaggctgatctccagactgcagtagtcattgcaaatgacattaaatctgaagcccaagaggagattggtgatctaaagcgccggttacatgaggctcaagaaaaaaatgagaaactcacaaaagaattggaggaaataaagtcacgcaagcaagaggaggagcgaggccgggtatacaattacatgaatgccgttgagagagatttggcagccttaaggcagggaatgggactgagtagaaggtcctcgacttcctcagagccaactcctacagtaaaaaccctcatcaagtcctttgacagtgcatctcaagtaccaaaccctgctgcagctgcaattcctcgaacgcccctgagcccaagtcctatgaaaacccctcctgcagcagctgtgtcccctatgcagatggagtctagttctgtcgcccacgctggaatgcagtggcgtgaccttggctcactgcaacctctgcctcctgggttcaagtga

SEQ ID NO: 29696 - DNA, 2565 bp, Homo sapiens
aagggcggggcccgcgagggaggccgggcggcccggcaagcggcgctgcggggtaggctgctttcctgaggccggactcaacgggtctcggctgagccaccgggtgagctcaccgcccagcccaaaccaggagattgcgagggagcgatgcggtgcagcgcgatttgcttgtaaatgcatcacgaagaggcagcccagaatgaagaaagcaagcaggagtgttggctcagtgcctaaagtgtctgcaataagtaaaacgcaaacagcagaaaaaattaaacctgaaaacagctcttcagcatctacgggaggcaaacttgtaaaacctggaacagcagcatcattgtcaaagaccaagagcagtgatgaccttttagctggaatggccggaggggtaacggtgactaatggtgttaaaggaaagaaaagcacctgcccatctgcagcaccttcagcatctgcccctgccatgaccaccgtggagaacaaatccaagattagcacaggcacagcttcttcaaccaagcggagcacttctacaggtaataaagaatccagttctactagagaaagattacgtgaacgtacccgattaaaccagagcaaaaaactaccttctgcaggtcagggagctaatgacatggcattggccaaacgttcccgcagtcgaactgctacagaatgtgacgttcgtatgagcaagtctaagtcagacaatcagatcagtgacagagctgctttggaggccaaagtgaaggatcttctcacgctggcaaaaaccaaagacgtagaaattttacatttgagaaatgaactgcgagacatgcgtgcccagctgggcattaatgaggatcattctgagggtgatgaaaaatctgagaaggaaactattatggctcaccagccgactgatgtggagtccactttattgcagttgcaggaacagaatactgccatccgtgaagaactcaaccagctgaaaaatgaaaacagaatgttaaaggacaggttgaatgcattgggcttttccctagagcagaggttagacaattctgaaaaactgtttggctatcagtccctgagcccagaaatcacccctgataaccagagcgatggaggaggaactctgacttcttcagtggaaggctctgcccctggctcagtggaggatctcttgagtcaggatgaaaatacactaatggaccatcagcacagtaactccatggacaatttagacagtgagtgcagtgaggtctaccagcccctcacatcgagcgatgatgcgctggatgcaccatcctcctcagagtcggaaggcatccccagcatagagcgctcccggaaggggagcagcgggaatgccagtgaagtgtccgtggcttgcctgactgaacggatacaccagatggaagagaaccaacacagtacaagtgaggaactccaggcaaccctgcaagagctagctgatttacagcagattacccaggaactgaatagtgaaaacgaaaggcttggagaagagaaggttattctgatggagtctttatgtcagcagagcgataagttggaacactttagtcgacagattgaatacttccgctctcttctagatgagcatcacatttcttatgtcatagatgaagatgtaaaaagtgggcgctatatggaattagagcaacgttacatggacctcgctgagaatgcccgttttgaacgggagcagcttcttggtgtccagcagcatttaagcaatactttgaaaatggcagaacaagacaataaggaagctcaagaaatgataggggcactcaaagaacgcagtcaccatatggagcgaattattgagtctgagcagaaaggaaaagcagccttggcagccacgttagaggaatacaaagccacagtggccagtgaccagatagagatgaatcgcctgaaggctcagctggagaatgaaaagcagaaagtggcagagctgtattctatccataactctggagacaaatctgatattcaggacctcctggagagtgtcaggctggacaaagaaaaagcagagactttggctagtagcttgcaggaagatctggctcatacccgaaatgatgccaatcgattacaggatgccattgctaaggtagaggatgaataccgagccttccaagaagaagctaagaaacaaattgaagatttgaatatgacgttagaaaaattaagatcagacctggatgaaaaagaaacagaaaggagtgacatgaaagaaaccatctttgaacttgaagatgaagtagaacaacatcgtgctgtgaaacttcatgacaacctcattatttctgatctagagaatacagttaaaaaactccaggaccaaaagcacgacatggaaagagaaataaagacactccacagaagacttcgggaagaatctgcggaatggcggcagtttcaggctgatctccagactgcagtagtcattgcaaatgacattaaatctgaagcccaagaggagattggtgatctaaagcgccggttacatgaggctcaagaaaaaaatgagaaactcac

SEQ ID NO: 29697 - DNA, 6673 bp, Homo sapiens
ggccaagggcggggcccgcgagggaggccgggcggcccggcaagcggcgctgcggggtaggctgctttcctgaggccggactcaacgggtctcggctgagccaccgggtgagctcaccgcccagcccaaaccaggagattgcgagggagcgatgcggtgcagcgcgatttgcttgtaaatgcatcacgaagaggcagcccagaatgaagaaagcaagcaggagtgttggctcagtgcctaaagtgtctgcaataagtaaaacgcaaacagcagaaaaaattaaacctgaaaacagctcttcagcatctacgggaggcaaacttgtaaaacctggaacagcagcatcattgtcaaagaccaagagcagtgatgaccttttagctggaatggccggaggggtaacggtgactaatggtgttaaaggaaagaaaagcacctgcccatctgcagcaccttcagcatctgcccctgccatgaccaccgtggagaacaaatccaagattagcacaggcacagcttcttcaaccaagcggagcacttctacaggtaataaagaatccagttctactagagaaagattacgtgaacgtacccgattaaaccagagcaaaaaactaccttctgcaggtcagggagctaatgacatggcattggccaaacgttcccgcagtcgaactgctacagaatgtgacgttcgtatgagcaagtctaagtcagacaatcagatcagtgacagagctgctttggaggccaaagtgaaggatcttctcacgctggcaaaaaccaaagacgtagaaattttacatttgagaaatgaactgcgagacatgcgtgcccagctgggcattaatgaggatcattctgagggtgatgaaaaatctgagaaggaaactattatggctcaccagccgactgatgtggagtccactttattgcagttgcaggaacagaatactgccatccgtgaagaactcaaccagctgaaaaatgaaaacagaatgttaaaggacaggttgaatgcattgggcttttccctagagcagaggttagacaattctgaaaaactgtttggctatcagtccctgagcccagaaatcacccctgataaccagagcgatggaggaggaactctgacttcttcagtggaaggctctgcccctggctcagtggaggatctcttgagtcaggatgaaaatacactaatggaccatcagcacagtaactccatggacaatttagacagtgagtgcagtgaggtctaccagcccctcacatcgagcgatgatgcgctggatgcaccatcctcctcagagtcggaaggcatccccagcatagagcgctcccggaaggggagcagcgggaatgccagtgaagtgtccgtggcttgcctgactgaacggatacaccagatggaagagaaccaacacagtacaagtgaggaactccaggcaaccctgcaagagctagctgatttacagcagattacccaggaactgaatagtgaaaacgaaaggcttggagaagagaaggttattctgatggagtctttatgtcagcagagcgataagttggaacactttagtcgacagattgaatacttccgctctcttctagatgagcatcacatttcttatgtcatagatgaagatgtaaaaagtgggcgctatatggaattagagcaacgttacatggacctcgctgagaatgcccgttttgaacgggagcagcttcttggtgtccagcagcatttaagcaatactttgaaaatggcagaacaagacaataaggaagctcaagaaatgataggggcactcaaagaacgcagtcaccatatggagcgaattattgagtctgagcagaaaggaaaagcagccttggcagccacgttagaggaatacaaagccacagtggccagtgaccagatagagatgaatcgcctgaaggctcagctggagaatgaaaagcagaaagtggcagagctgtattctatccataactctggagacaaatctgatattcaggacctcctggagagtgtcaggctggacaaagaaaaagcagagactttggctagtagcttgcaggaagatctggctcatacccgaaatgatgccaatcgattacaggatgccattgctaaggtagaggatgaataccgagccttccaagaagaagctaagaaacaaattgaagatttgaatatgacgttagaaaaattaagatcagacctggatgaaaaagaaacagaaaggagtgacatgaaagaaaccatctttgaacttgaagatgaagtagaacaacatcgtgctgtgaaacttcatgacaacctcattatttctgatctagagaatacagttaaaaaactccaggaccaaaagcacgacatggaaagagaaataaagacactccacagaagacttcgggaagaatctgcggaatggcggcagtttcaggctgatctccagactgcagtagtcattgcaaatgacattaaatctgaagcccaagaggagattggtgatctaaagcgccggttacatgaggctcaagaaaaaaatgagaaactcacaaaagaattggaggaaataaagtcacgcaagcaagaggaggagcgaggccgggtatacaattacatgaatgccgttgagagagatttggcagccttaaggcagggaatgggactgagtagaaggtcctcgacttcctcagagccaactcctacagtaaaaaccctcatcaagtcctttgacagtgcatctcaagtaccaaaccctgctgcagctgcaattcctcgaacgcccctgagcccaagtcctatgaaaacccctcctgcagcagctgtgtcccctatgcagagacattccataagtggaccaatctcaacatccaaacccctgacagccctgtcagataagagaccaaactatggggaaatccctgttcaagagcatctgttaagaacatcttcagccagccggcctgcttccctgccaagagtgcctgcgatggaaagtgccaagaccctctcagtgtctcgacgaagtagtgaagaagtgaaacgggacatttctgcacaggagggagcgtcgccagcctctctgatggctatgggaaccacgtctccacagctttccctgtcctcttctccaacggcatctgtgactcccaccacccgaagccgaataagagaagaaaggaaagaccctctctcagcattggccagagaatatggaggatcaaagaggaacgccttgctgaagtggtgtcagaagaaaacagaaggctatcagaatattgacattacaaacttcagcagcagctggaatgatgggctggccttctgtgccctcctgcatacatatctccctgcccacattccatatcaagaactgaacagccaggataagagaaggaacttcatgctggctttccaggcagctgaaagtgtcggcatcaaatccacactggacattaatgaaatggtacggactgaacgacccgactggcagaacgtgatgctgtatgtgacggcgatctacaagtactttgagacctgagcatgccgggaggagccgccccaatagcgggggtacccctccacagcgaccgagcgacaccgacgccattagctacgcacccctgtaaagcttccagcaactctgggctgccccacagcgtgtgagcctccagctcggggcttccgtattggaagaactcagccgtgtggcccacagctcccaccagggcccctcccacatgacccgtccattcaggtcatgtgggctcagcacacatcctgcaggccggtggctgctggagttttccttctgaagagaatattgaactacactagtgctccagggcaccaaacaaaaagggctcatgcacagctgaatttgggaaaagggattcagttctgtgggaaactcactagggttgatgaaggctcggccgcggcacttcctgactattggctggggtgggttccggtgctggtgagaacccagaaggagagtcagcgcctggcagttcccagcgccctgggcccttcaccgtcctagtttggaggagcatgttcaccacagacgtgggtcagctgccccacacctgacggggctgtcccggccgacacaatccaggcgtgttcagcctgagctaggagagtatctagagggcgtggtgcgggcacgccagggctggggtgctgctgctgcactcacgcggctgggctttctggcgggaagcagttacgggggccccttgcctggactcagcgacctgtcttccagcctggaaggggtttggagtcccagctctggctttagatttcttcatcataaggagtttttctagttaacatttttgttttgttacgagcaatgctggaaaaggtcgctcctgttctgttagtaccaaagttacattgtttcaataagcatagaaatctaaacaacatctgtacattagcatggtgagagcaaggaataaagcaggaaataggagaaaagtaaacaactttagggagcccaggcagtgtcatttaaactcactgagtcactaagacataattctcctaggccagagttaaagaaagtgccttaactcttcttgtgagggcagccactgccctccgtggccaaggcaggacctccaagactcagtggttgagttgtctcctaccaccatgcccgccctccccaggtactgggtccatgccccctgtgcccaccctccccaggtgctgggtccatgctgtttgaaccaaagccttatttaaaggtggtcactggagatgctctcaggccagaactcaacagctatttttgggaatagggatctcccgtgtgcctaacgcagtagctattggtttgaacaatgtccagacaagacctgtacctttgagaatataactgtgtttggcacctgcatagcaccatgaggaagaccagccaccagtggaagcggggtcactgccccacagactggatgcaatgaggggctcacaggaggcccagccagcccgattgtgggctgaggggtctgcattcaagcacgatgttctagaataggagtttaacgtgtctacgtaacctagaatgtggttattaggaaaggggctgtgcatgtgggtgcagctggcggcacacctggtcaccagatggccagaagctgcccatcagccctgcccagatgtcagcctgggagctcaggctgctgccgctggctggatgccctttggtgaaatgcctgttttcagctaagaaaggagaggccaggcaagcaaagtcatgccacaaagcatatcagagacccccgcagactcctggccccgtcccgccccctgtctgagttgtgtttttgttgctgttcctctgttgatggccagctctgctgttggcatgagccactgatgttcatgtgagaattactgtttttaagtgtctctccacttaggtgtcctcagttcccacttttgctctcatttgccttcacagaggccactccacctgtccggatccagctgtctggtcatggtttggtttatttattttgtccttcaggggctgttttgccctaagaatgagggggcttcccctggtctgcagttcccaactttatcccttgctggccatgcgagcccagccctggtgcctcatgggatgggggggtaggggtccccaggatcttctggaggaaggtggccatggatggatgggctgtatctgtgttttccctctgggagtctcatgggtccagcatcaggcctgaggtcagcaacagggaaagagggtgggcacggggagggcttggccccgcctatctagaggcttgcctcgggcccctccttggggaaggtttgcgtgcagagctgcaagggagagggttccagaagcattgccttttgcctcgtctaataggatccttaggacactgtgggctttaggaatgactatagatgctcacacgtgtttaaagtgacatttggagatgctctcagtcctgtggcatctggcacgaagtctccaagaagccactttgcctcttctcccttcaagcacaagctttactgcaaaagggccagtcgcgtttctatttctctcgatcccaggcttctgcggaccgacgatacgtttaaatgttgttctagtaaatattcttgaatgtattaaaatggctgaaacaacaagcttgggcttttctagcttgccctccactccctgccgtccctctgacgtcgcataaaccagaacccagctccctcctgggactggctgtggagagaagggcacctctgagccagcctgtggccctaccccaaggcgcacttcctcatgtgggcagatcctgaccaggagtccagggtggcctcccctgggccacagcacatcaccgtgtggcctggggctgtgggacagtgagccctgtaaccactagggttctgtgacagatgccaagaccccagagaccgtggcagagctacccccaggagagcggaagcccctacacagcccagacacatgccttccctgggggctggggagtgtgtctcgaggggttttgtttgttttgaggcatgtatcatcttggaaataattgtcaggatgtataaaatagagaaaaagaaaaaaggtatcctacccagaggcaaccagataaacttttttgcctgtgc

SEQ ID NO: 29698 - DNA, 3525 bp, Homo sapiens
tttcctgaggccggactcaacgggtctcggctgagccaccgggtgagctcaccgcccagcccaaaccaggagattgcgagggagcgatgcggtgcagcgcgatttgcttgtaaatgcatcacgaagaggcagcccagaatgaagaaagcaagcaggagtgttggctcagtgcctaaagtgtctgcaataagtaaaacgcaaacagcagaaaaaattaaacctgaaaacagctcttcagcatctacgggaggcaaacttgtaaaacctggaacagcagcatcattgtcaaagaccaagagcagtgatgaccttttagctggaatggccggaggggtaacggtgactaatggtgttaaaggaaagaaaagcacctgcccatctgcagcaccttcagcatctgcccctgccatgaccaccgtggagaacaaatccaagattagcacaggcacagcttcttcaaccaagcggagcacttctacaggtaataaagaatccagttctactagagaaagattacgtgaacgtacccgattaaaccagagcaaaaaactaccttctgcaggtcagggagctaatgacatggcattggccaaacgttcccgcagtcgaactgctacagaatgtgacgttcgtatgagcaagtctaagtcagacaatcagatcagtgacagagctgctttggaggccaaagtgaaggatcttctcacgctggcaaaaaccaaagacgtagaaattttacatttgagaaatgaactgcgagacatgcgtgcccagctgggcattaatgaggatcattctgagggtgatgaaaaatctgagaaggaaactattatggctcaccagccgactgatgtggagtccactttattgcagttgcaggaacagaatactgccatccgtgaagaactcaaccagctgaaaaatgaaaacagaatgttaaaggacaggttgaatgcattgggcttttccctagagcagaggttagacaattctgaaaaactgtttggctatcagtccctgagcccagaaatcacccctgataaccagagcgatggaggaggaactctgacttcttcagtggaaggctctgcccctggctcagtggaggatctcttgagtcaggatgaaaatacactaatggaccatcagcacagtaactccatggacaatttagacagtgagtgcagtgaggtctaccagcccctcacatcgagcgatgatgcgctggatgcaccatcctcctcagagtcggaaggcatccccagcatagagcgctcccggaaggggagcagcgggaatgccagtgaagtgtccgtggcttgcctgactgaacggatacaccagatggaagagaaccaacacagtacaagtgaggaactccaggcaaccctgcaagagctagctgatttacagcagattacccaggaactgaatagtgaaaacgaaaggcttggagaagagaaggttattctgatggagtctttatgtcagcagagcgataagttggaacactttagtcgacagattgaatacttccgctctcttctagatgagcatcacatttcttatgtcatagatgaagatgtaaaaagtgggcgctatatggaattagagcaacgttacatggacctcgctgagaatgcccgttttgaacgggagcagcttcttggtgtccagcagcatttaagcaatactttgaaaatggcagaacaagacaataaggaagctcaagaaatgataggggcactcaaagaacgcagtcaccatatggagcgaattattgagtctgagcagaaaggaaaagcagccttggcagccacgttagaggaatacaaagccacagtggccagtgaccagatagagatgaatcgcctgaaggctcagctggagaatgaaaagcagaaagtggcagagctgtattctatccataactctggagacaaatctgatattcaggacctcctggagagtgtcaggctggacaaagaaaaagcagagactttggctagtagcttgcaggaagatctggctcatacccgaaatgatgccaatcgattacaggatgccattgctaaggtagaggatgaataccgagccttccaagaagaagctaagaaacaaattgaagatttgaatatgacgttagaaaaattaagatcagacctggatgaaaaagaaacagaaaggagtgacatgaaagaaaccatctttgaacttgaagatgaagtagaacaacatcgtgctgtgaaacttcatgacaacctcattatttctgatctagagaatacagttaaaaaactccaggaccaaaagcacgacatggaaagagaaataaagacactccacagaagacttcgggaagaatctgcggaatggcggcagtttcaggctgatctccagactgcagtagtcattgcaaatgacattaaatctgaagcccaagaggagattggtgatctaaagcgccggttacatgaggctcaagaaaaaaatgagaaactcacaaaagaattggaggaaataaagtcacgcaagcaagaggaggagcgaggccgggtatacaattacatgaatgccgttgagagagatttggcagccttaaggcagggaatgggactgagtagaaggtcctcgacttcctcagagccaactcctacagtaaaaaccctcatcaagtcctttgacagtgcatctcaagtaccaaaccctgctgcagctgcaattcctcgaacgcccctgagcccaagtcctatgaaaacccctcctgcagcagctgtgtcccctatgcagagacattccataagtggaccaatctcaacatccaaacccctgacagccctgtcagataagagaccaaactatggggaaatccctgttcaagagcatctgttaagaacatcttcagccagccggcctgcttccctgccaagagtgcctgcgatggaaagtgccaagaccctctcagtgtctcgacgaagtagtgaagaagtgaaacgggacatttctgcacaggagggagcgtcgccagcctctctgatggctatgggaaccacgtctccacagctttccctgtcctcttctccaacggcatctgtgactcccaccacccgaagccgaataagagaagaaaggaaagaccctctctcagcattggccagagaatatggaggatcaaagaggaacgccttgctgaagtggtgtcagaagaaaacagaaggctatcagagaaggaacttcatgctggctttccaggcagctgaaagtgtcggcatcaaatccacactggacattaatgaaatggtacggactgaacgacccgactggcagaacgtgatgctgtatgtgacggcgatctacaagtactttgagacctgagcatgccgggaggagccgccccaatagcgggggtacccctccacagcgaccgagcgacaccgacgccattagctacgcacccctgtaaagcttccagcaactctgggctgccccacagcgtgtgagcctccagctcggggcttccgtatt

SEQ ID NO: 29699 - DNA, 3747 bp, Homo sapiens
gacgagaccctccctcagcacctgcagtgcagccagagccggtgcggcggccgcgacttccccgacgcggggcgctgagaagcactatgaccaccaaagattatccatcattgtggggctttggaacaacaaaaacattcaaaattcccattgaacatctagatttcaaatacattgaaaaatgttcagatgttaaacatctggaaaaaattctttgcgtgctcagatctggtgaggaaggatattatcctgaacttacagaattttgtgaaaagcatcttcaagccttggcccctgaaagcagagctttgaggaaagataaaccagcagcaacagcagccagttttacagctgaagaatgggaaaaaattgatggtgatataaagagttgggtatcagaaattaaaaaagaagaagataaaatgcactttcatgaaactgagacatttccagcaatgaaagataatttgcctccagttcgtggttcaaacagctgtcttcatgtaggcaaggaaaaatattctaaaagaccaactaaaaagaaaactccaagggattacgcggaatgggataaatttgacgtggagaaggaatgtttaaaaattgatgaagattacaaagaaaagacggtaatagacaagtcacacttgtctaaaattgagacaagaatagatacagcaggtctaactgagaaagaaaaggattttcttgccactcgtgaaaaggagaaaggaaatgaagctttcaactcaggagattatgaagaagcagtgatgtattataccaggagcatatcagcgcttcccactgtagttgcctataacaatcgagctcaagcagaaatcaaattacagaactggaatagtgcttttcaggattgtgaaaaggtcttggagttagaacctggaaacgtaaaggctcttctgcgtcgtgctactacatataaacatcaaaacaagctccgggaagctacagaagatttgagtaaagtactagatgttgagcctgataatgatttggccaagaaaaccttgtcagaggttgaaagagatctgaaaaattctgaagctgcatctgagactcaaaccaaagggaaaaggatggttattcaggaaatagaaaactccgaagatgaagaaggaaaaagcggaagaaaacatgaagatggcggtggagataagaagcccgcggagccggcgggagccgcgcgcgccgcccagccgtgcgtcatgggcaacatccagaagaagctgactggcaaagccgaaggcggcaagcggccggcaaggggcgcgccgcagcggggccagaccccggaggccggcgcggacaagcggagcccacggcgggcctctgcggcggcggcggcgggcggcggcgccaccgggcatccgggcggcgggcagggcgcggagaaccctgccggcctgaagagccagggcaacgagctgttccgaagcgggcagttcgccgaggcggccggcaagtactcggcggcaatcgcgctcctggagccagcaggaagtgaaattgcagatgatctaagtatcttatattcaaatagagcagcatgttacctaaaagaaggaaactgcagtggctgcattcaagattgtaacagggctctggaacttcatccattctctatgaaacctcttctgaggcgggcgatggcctatgaaactctagagcagtatgggaaagcttatgtggattataaaacagtgttgcagatagactgtggactccagctagcaaatgacagtgttaacaggctatcaagaattttaatggagctggatggaccaaattggcgggagaagctgtcacctattcctgctgtgcctgcttctgtgccactgcaagcttggcatccggcaaaagagatgatctcaaaacaagcaggagactccagcagccatcgccagcagggcatcacagatgaaaaaacatttaaagcccttaaggaagaaggaaatcaatgtgtaaatgacaaaaactataaagacgccctcagtaaatacagcgaatgcttaaagattaacaataaggaatgtgccatatatacaaacagagctctctgttacttgaagctgtgccagtttgaagaagcaaagcaggactgtgatcaggcacttcagctagctgatgggaacgtgaaagccttctatagacgagctctggctcataaaggactcaagaattatcagaaaagcttaattgatctcaataaagttatcctactagatccaagtattattgaggcaaagatggaactggaagaggtaactagactccttaatcttaaggataagacagcaccattcaacaaagaaaaggagagaaggaaaattgagattcaagaggtgaatgaaggcaaggaggagcctggaagacctgcaggggaggtctccatgggatgccttgcttctgagaagggaggcaaaagcagcaggtcaccagaagaccctgagaaacttccgatagccaagcctaataatgcctatgaatttggtcagattataaatgctctcagtaccaggaaggataaagaagcctgtgcacatcttttagccatcactgcaccaaaagatttgccgatgtttttaagtaacaaacttgaaggggatacattccttctcctcattcagtctctgaaaaataatcttattgaaaaagatccctcattggtgtatcagcatcttttatacctgagtaaagcagaaaggtttaagatgatgttgacactaattagcaagggccaaaaggagctaattgaacagctgtttgaggacctttcggacacaccaaacaaccattttactttagaagatatacaggccctaaaaaggcagtatgagctttaaatcaagataattgttagatttcttccatgcatgtatgtgttccaggaatgttaatgagatggtattgtaaaagagttgcatggataaaacttggcctagaaaagtttggtctgcactataaaacattttacttattttcctacatagaacatgtatattctacaatctgctttttattagttgtaaatattttcttatgtaccagaaccaaataagtatatttagaacttgttaaaaatacattttaatttatgatatacatattattttaattacttgttaaaattttgagttaagttgcatttctttgggctatgaaggagtcctcttaagtttgatagaaatgaatttcttgtaacattcttttttaaaagtggaagtcattaacagtgattattatatcacttatatcctgctaagatacacataaatcccattttgtactagtacctgtggattacagtcagttaaaatgaaatgcaacactgaagtctataacatgaaatgattattaaattgtttattaatttagagctataagaggaacttattttttctaatacggaagcattgcctaataattaagaacaaaaattgccaaaaatttctaccactttttactagattttaaaaagctactttcttttatattgcctatataagcaaaaaaccaaccactgtattaaagcaaactaagcctgcatttatatctgaattattacctccatattttaccaaacatttgaatgtcccccttcccccttttttgttttctgcttttatgactgtatttattcctttactgtaaaagaatatgaagaactcatacatgttgaaagctcctttgttgactgggtcaaagtgaaggaatttcaatctc

SEQ ID NO: 29700 - DNA, 3852 bp, Homo sapiens
ggggctccccagtcccggcaggtcctggcgccgctgtacatagaaaccgttgccacggcgggaggatgccgtttcttttcggtctccgactgcagggggcggtcggccctgtggatgcaggaaagagggtgcctcggtgggagagacccagcttttcgcgttagtaggcccgagcagtttgaactggagctatgaccaccaaagattatccatcattgtggggctttggaacaacaaaaacattcaaaattcccattgaacatctagatttcaaatacattgaaaaatgttcagatgttaaacatctggaaaaaattctttgcgtgctcagatctggtgaggaaggatattatcctgaacttacagaattttgtgaaaagcatcttcaagccttggcccctgaaagcagagctttgaggaaagataaaccagcagcaacagcagccagttttacagctgaagaatgggaaaaaattgatggtgatataaagagttgggtatcagaaattaaaaaagaagaagataaaatgcactttcatgaaactgagacatttccagcaatgaaagataatttgcctccagttcgtggttcaaacagctgtcttcatgtaggcaaggaaaaatattctaaaagaccaactaaaaagaaaactccaagggattacgcggaatgggataaatttgacgtggagaaggaatgtttaaaaattgatgaagattacaaagaaaagacggtaatagacaagtcacacttgtctaaaattgagacaagaatagatacagcaggtctaactgagaaagaaaaggattttcttgccactcgtgaaaaggagaaaggaaatgaagctttcaactcaggagattatgaagaagcagtgatgtattataccaggagcatatcagcgcttcccactgtagttgcctataacaatcgagctcaagcagaaatcaaattacagaactggaatagtgcttttcaggattgtgaaaaggtcttggagttagaacctggaaacgtaaaggctcttctgcgtcgtgctactacatataaacatcaaaacaagctccgggaagctacagaagatttgagtaaagtactagatgttgagcctgataatgatttggccaagaaaaccttgtcagaggttgaaagagatctgaaaaattctgaagctgcatctgagactcaaaccaaagggaaaaggatggttattcaggaaatagaaaactccgaagatgaagaaggaaaaagcggaagaaaacatgaagatggcggtggagataagaagcccgcggagccggcgggagccgcgcgcgccgcccagccgtgcgtcatgggcaacatccagaagaagctgactggcaaagccgaaggcggcaagcggccggcaaggggcgcgccgcagcggggccagaccccggaggccggcgcggacaagcggagcccacggcgggcctctgcggcggcggcggcgggcggcggcgccaccgggcatccgggcggcgggcagggcgcggagaaccctgccggcctgaagagccagggcaacgagctgttccgaagcgggcagttcgccgaggcggccggcaagtactcggcggcaatcgcgctcctggagccagcaggaagtgaaattgcagatgatctaagtatcttatattcaaatagagcagcatgttacctaaaagaaggaaactgcagtggctgcattcaagattgtaacagggctctggaacttcatccattctctatgaaacctcttctgaggcgggcgatggcctatgaaactctagagcagtatgggaaagcttatgtggattataaaacagtgttgcagatagactgtggactccagctagcaaatgacagtgttaacaggctatcaagaattttaatggagctggatggaccaaattggcgggagaagctgtcacctattcctgctgtgcctgcttctgtgccactgcaagcttggcatccggcaaaagagatgatctcaaaacaagcaggagactccagcagccatcgccagcagggcatcacagatgaaaaaacatttaaagcccttaaggaagaaggaaatcaatgtgtaaatgacaaaaactataaagacgccctcagtaaatacagcgaatgcttaaagattaacaataaggaatgtgccatatatacaaacagagctctctgttacttgaagctgtgccagtttgaagaagcaaagcaggactgtgatcaggcacttcagctagctgatgggaacgtgaaagccttctatagacgagctctggctcataaaggactcaagaattatcagaaaagcttaattgatctcaataaagttatcctactagatccaagtattattgaggcaaagatggaactggaagaggtaactagactccttaatcttaaggataagacagcaccattcaacaaagaaaaggagagaaggaaaattgagattcaagaggtgaatgaaggcaaggaggagcctggaagacctgcaggggaggtctccatgggatgccttgcttctgagaagggaggcaaaagcagcaggtcaccagaagaccctgagaaacttccgatagccaagcctaataatgcctatgaatttggtcagattataaatgctctcagtaccaggaaggataaagaagcctgtgcacatcttttagccatcactgcaccaaaagatttgccgatgtttttaagtaacaaacttgaaggggatacattccttctcctcattcagtctctgaaaaataatcttattgaaaaagatccctcattggtgtatcagcatcttttatacctgagtaaagcagaaaggtttaagatgatgttgacactaattagcaagggccaaaaggagctaattgaacagctgtttgaggacctttcggacacaccaaacaaccattttactttagaagatatacaggccctaaaaaggcagtatgagctttaaatcaagataattgttagatttcttccatgcatgtatgtgttccaggaatgttaatgagatggtattgtaaaagagttgcatggataaaacttggcctagaaaagtttggtctgcactataaaacattttacttattttcctacatagaacatgtatattctacaatctgctttttattagttgtaaatattttcttatgtaccagaaccaaataagtatatttagaacttgttaaaaatacattttaatttatgatatacatattattttaattacttgttaaaattttgagttaagttgcatttctttgggctatgaaggagtcctcttaagtttgatagaaatgaatttcttgtaacattcttttttaaaagtggaagtcattaacagtgattattatatcacttatatcctgctaagatacacataaatcccattttgtactagtacctgtggattacagtcagttaaaatgaaatgcaacactgaagtctataacatgaaatgattattaaattgtttattaatttagagctataagaggaacttattttttctaatacggaagcattgcctaataattaagaacaaaaattgccaaaaatttctaccactttttactagattttaaaaagctactttcttttatattgcctatataagcaaaaaaccaaccactgtattaaagcaaactaagcctgcatttatatctgaattattacctccatattttaccaaacatttgaatgtcccccttcccccttttttgttttctgcttttatgactgtatttattcctttactgtaaaagaatatgaagaactcatacatgttgaaagctcctttgttgactgggtcaaagtgaaggaatttcaatctc

SEQ ID NO: 29701 - DNA, 1048 bp, Homo sapiens
agagatggctgctcagcgagggatgcccagctccgccgtgagggtcctggaagaggcgttgggcatgggtttgacggcagccggggacgcgagggacacggcggacgcggtggcggctgagggcgcctactacctggaacaggtcaccataactgaagcatctgaagatgactatgaatatgaagagataccagatgacaattttagcatcccagaaggtgaagaagatctggcaaaagcaattcagatggcccaagaacaggctacagatactgaaattttggaacggaaaacagttcttccttcaaagcatgcagtacctgaagtaatagaagactttctctgcaatttcttgatcaaaatgggaatgaccagaactcttgattgctttcagtctgaatggtatgagttaatacagaaaggagtgactgaacttagaactgttgggaatgttccagatgtctacacccagattatgcttttggaaaatgagaacaaaaatttaaagaaagatttgaagcactacaaacaagcagctgacaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaagttgatcatagtcgtgaaaaagaaaatgcaccagaaggtcctactcagaaaggtcttcgtgaagccagggaacaaaacaaatgtaaaacaaagatgaaaggcaatacaaagcagtggacagggaactctcaaacttggaataagaccgtacctctgcaggacactattggcaggagacaagagaacaacagtgcacaccagcacatcgactaa

SEQ ID NO: 29702 - DNA, 2177 bp, Homo sapiens
cgcgagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacaggtcaccataactgaagcatctgaagatgactatgaatatgaagagataccagatgacaattttagcatcccagaaggtgaagaagatctggcaaaagcaattcagatggcccaagaacaggctacagatactgaaattttggaacggaaaacagttcttccttcaaagcatgcagtacctgaagtaatagaagactttctctgcaatttcttgatcaaaatgggaatgaccagaactcttgattgctttcagtctgaatggtatgagttaatacagaaaggagtgactgaacttagaactgttgggaatgttccagatgtctacacccagattatgcttttggaaaatgagaacaaaaatttaaagaaagatttgaagcactacaaacaagcagctgacaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaagttgatcatagtcgtgaaaaagaaaatgcaccagaaggtcctactcagaaaggtcttcgtgaagccagggaacaaaacaaatgtaaaacaaagatgaaaggcaatacaaaggattcagaatttcccatagatatgcaaccaaatccaaacctgaatgtttctaaagaaagtctttctccagcaaaatttgactacaagctgaaaaacatttttagactccatgaacttccagtgagctgtgtctccatgcaaccccacaaagacatcctagtctcctgtggcgaggaccgactctggaaggtgttgggccttccaaaatgcaatgtgcttctcacgggatttggccacactgactggctttcagactgctgcttccatcccagtggcgacaaattggctacttcaagtggtgacactacagttaaattatgggatctatgtaaaggcgattgcattttgacctttgaaggacacagccgcgcagtgtggtcctgcacatggcactcctgcggcaattttgtggcttcctcctcactggataaaactagcaaaatttgggatgttaatagtgaaagatgcagatgtactttgtatggacatacagattctgtgaacagcattgagttttttcctttctccaatactcttctcacaagctctgcagacaagaccctgtctatatgggatgcaagaacaggtatatgtgagcagtcactttatggtcacatgcattctatcaatgatgccatttttgatcccaggggtcacatgatagcatcctgtgatgcctgtggggttacaaagctgtgggactttcggaagctgttaccaattgtgtccatcgatataggtccaagtcctggcaatgaggtgaattttgattcatcaggtcgagttttagctcaggcaagtggcaatggtgttatccatttgctagatcttaaatctggggagattcacaaattgatgggccacgaaaacgaggcacacacggttgtgttttctcacgacggggagattctcttttctggaggctctgacggcacagttcgaacgtggtcttgaccgtcagcacatcccgctgcagagggcattccctttaaggcttgaaaatgcctcctgtagtcccaaaccagcaaagaactggttaaatgtgccagcaggtaacatttacagtctgctttaaaacatgctttggacatatattttagtgctcatactgttactaataaaaaaataactttatgctca

SEQ ID NO: 29703 - DNA, 1614 bp, Homo sapiens
atgactatgaatatgaagagataccagatgacaattttagcatcccagaaggtgaagaagatctggcaaaagcaattcagatggcccaagaacaggctacagatactgaaattttggtatgagttaatacagaaaggagtgactgaacttagaactgttgggaatgttccagatgtctacacccagattatgcttttggaaaatgagaacaaaaatttaaagaaagatttgaagcactacaaacaagcagctgacaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaagttgatcatagtcgtgaaaaagaaaatgcaccagaaggtcctactcagaaaggtcttcgtgaagccagggaacaaaacaaatgtaaaacaaagatgaaaggcaatacaaaggattcagaatttcccatagatatgcaaccaaatccaaacctgaatgtttctaaagaaagtctttctccagcaaaatttgactacaagctgaaaaacatttttagactccatgaacttccagtgagctgtgtctccatgcaaccccacaaagacatcctagtctcctgtggcgaggaccgactctggaaggtgttgggccttccaaaatgcaatgtgcttctcacgggatttggccacactgactggctttcagactgctgcttccatcccagtggcgacaaattggctacttcaagtggtgacactacagttaaattatgggatctatgtaaaggcgattgcattttgacctttgaaggacacagccgcgcagtgtggtcctgcacatggcactcctgcggcaattttgtggcttcctcctcactggataaaactagcaaaatttgggatgttaatagtgaaagatgcagatgtactttgtatggacatacagattctgtgaacagcattgagttttttcctttctccaatactcttctcacaagctctgcagacaagaccctgtctatatgggatgcaagaacaggtatatgtgagcagtcactttatggtcacatgcattctatcaatgatgccatttttgatcccaggggtcacatgatagcatcctgtgatgcctgtggggttacaaagctgtgggactttcggaagctgttaccaattgtgtccatcgatataggtccaagtcctggcaatgaggtgaattttgattcatcaggtcgagttttagctcaggcaagtggcaatggtgttatccatttgctagatcttaaatctggggagattcacaaattgatgggccacgaaaacgaggcacacacggttgtgttttctcacgacggggagattctcttttctggaggctctgacggcacagttcgaacgtggtcttga

SEQ ID NO: 29704 - DNA, 2256 bp, Homo sapiens
agcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacgtatccttcccgtggaggcgcggcccgctgcgctggcgggtaatgggtgttgggacgaaggcgagggcctcccactggcggcgccttttgagccttggggccactccggaggagcctctgttggacttcaagataccagatgacaattttagcatcccagaaggtgaagaagatctggcaaaagcaattcagatggcccaagaacaggctacagatactgaaattttggaacggaaaacagttcttccttcaaagcatgcagtacctgaagtaatagaagactttctctgcaatttcttgatcaaaatgggaatgaccagaactcttgattgctttcagtctgaatggtatgagttaatacagaaaggagtgactgaacttagaactgttgggaatgttccagatgtctacacccagattatgcttttggaaaatgagaacaaaaatttaaagaaagatttgaagcactacaaacaagcagctgacaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaaggtaaatgtaaaatgtgatgaagctctcatttaatatagtttggtgatttctcaaccttatcagtgattaatattctagagatatttaaaggtgagtaagtggtggctatttcacaaattaaaattttaataaaaagattaagaagaaatatagatatcatactgtatggattaattatagagaaaaacaagtcaactataatggaaggacttctgcttctggtcattatacctggtaccagactagccttctctgtgtaaataactctaaagctaagctgtaagatcagacaactacttttaggcagtagaaaacagacagctcaagtaacagaaggcaattgacagaaggaaaatttataaggtgagctctgccatcaccatggctttgggtctgtggaaagttccaaactgagctttgtggagatggaagccaataagagcatgacaatcctgataattggaaatgtcagagaccctagttcacagcttttgaagccactggaatctgtagggaaagacaccagagaagagagctgcaatgaggagtggctcagtttgtgagggagtttactatgagtccttagctgaggctgcaatactatacataacaacactacctgacacttacaagagagatacaattatataggatcaagaggaggccagagattgtagaagttaagtagtgatgcgaaacattgcaaatctggccatgcctgggtggaaagacctctttcacaccttgttaacaacacagtaacattcagcatcccatatccgccttataaaaccaggaacaaagcttacacagcattcttagagaggacacagaatttggagtttgagtcttgccaagttatagggccttgagaaacatttagggctttccatggatccaccctaacgaagcataaaattaagcctaggattttagggtcatcagccaaaaatggaactgccttctagaacaaaaaatgacatccttttgaggaagacagtcatccagagtctttacaatcttttacccacattgcctagtacataattaaacatttctagatatgaataggaacaggaaaatgtgacccataatcaagacaacaagcaataaatggaaacctacccttaagtagctaaactgttgcatttagcagatagaaagtgctaaagtagatactttgattatgttcaaggacttaatggaaaatactaataagtgaacagatggggaatttaagcaaagaaatgagaacaagcatacattccaaa

SEQ ID NO: 29705 - DNA, 1250 bp, Homo sapiens
gagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacaggtcaccataactgaagcatctgaagatgactatgaatatgaagagataccagatgacaattttagcatcccagaaggtgaagaagatctggcaaaagcaattcagatggcccaagaacaggctacagatactgaaattttggaacggaaaacagttcttccttcaaagcatgcagtacctgaagtaatagaagactttctctgcaatttcttgatcaaaatgggaatgaccagaactcttgattgctttcagtctgaatggtatgagttaatacagaaaggagtgactgaacttagaactgttgggaatgttccagatgtctacacccagattatgcttttggaaaatgagaacaaaaatttaaagaaagatttgaagcactacaaacaagcagctgagtatgttattttttaaatgacattttcttctttttcttttggactaaataaaagagttgagtgaagctgatatatgtaatataccagagccttaatttttgaaaactgaatttttctagttgtaaagaatgtgagaggcttcattagcaaattaattaaacagatgatcagaactatcacaattataacttaccaacaagaagggaatgcaggtagttgtttaggagatggtacattttttatataacattcacttccttgtgtatttgatagtcttttcatggtttataacattttctcctgtaaagataggctaatttctgaaataataattaaatttatagaaagccgagaggaaattgctagtttattcctggtagaggaatttctgtatttgaaaattctccagaaggaataatataaactgtggactttgggtgataatgatatgtaggttcgtcagttgttaacaaatgtatccctctgttgggggctattgataatggggaaggctgtgcatgtgtgggagtaggaggtgtatgggacatctctgtaccttctaatcaattttgctatgaacttaaaactgctctaaaaataaagtttattaaaaaaaagttaa

SEQ ID NO: 29706 - DNA, 771 bp, Homo sapiens
gattcagaatttcccatagatatgcaaccaaatccaaacctgaatgtttctaaagaaagtctttctccagcaaaatttgactacaagctgaaaaacatttttagactccatgaacttccagtgagctgtgtctccatgcaaccccacaaagacatcctagtctcctgtggcgaggaccgactctggaaggtgttgggccttccaaaatgcaatgtgcttctcacgggatttggccacactgactggctttcagactgctgcttccatcccagtgaaagatgcagatgtactttgtatggacatacagattctgtgaacagcattgagttttttcctttctccaatactcttctcacaagctctgcagacaagaccctgtctatatgggatgcaagaacaggtatatgtgagcagtcactttatggtcacatgcattctatcaatgatgccatttttgatcccaggggtcacatgatagcatcctgtgatgcctgtggggttacaaagctgtgggactttcggaagctgttaccaattgtgtccatcgatataggtccaagtcctggcaatgaggtgaattttgattcatcaggtcgagttttagctcaggcaagtggcaatggtgttatccatttgctagatcttaaatctggggagattcacaaattgatgggccacgaaaacgaggcacacacggttgtgttttctcacgacggggagattctcttttctggaggctctgacggcacagttcgaacgtggtcttgaccg

SEQ ID NO: 29707 - DNA, 1453 bp, Homo sapiens
tcacgcagggtccgtggggtccccgcggcgcgcagcggctgaaggaggccccagggccttggcgaccgcagcggcggctttagcgtcagtgactaggcagcagggggtcaggatgcggcgaagctcccgcccgggctcggcctcgtcctcgcgcaagcacacgcccaactttttcagcgagaacagctcaatgagcatcacctcggaggacagcaaagggctccggtcagcggagcccgggcctggggagcccgagggcagaagagcccggggcccgagctgcggtgagcccgccttgagcgcgggagtgcccggaggaaccacatgggcaggaagctctcagcagaagccagcgcctcggagccacaactggcagacagcctgtggcgcggcaaccgtgaggggcggggcctcggaaccgactgggtctccagtagtctctgaggagccgctcgaccttctcccgaccctggatctgaggcaggagatgcctcccccgcgggtgttcaagagctttctgagcctgctcttccaggggctgagcgtgttgttatccctggcaggagacgtgctggtcagcatgtacagggaggtctgttccatccgcttcctgttcacggctgtgtcgctgctgagcctctttctgtcagcattctggctggggcttctgtacctggtctctcctttggagaatgaacctaaggagatgctgactctaagtgagtaccacgagcgcgtgcgctcccaggggcagcagctgcagcagctccaggccgagctggataaactccacaaggaggtgtccactgttcgggcagccaacagcgagagagtggccaagctcgtgttccagaggctgaatgaggattttgtgcggaagcccgactatgctttgagctctgtgggagcctccatcgacctgcagaagacatcccacgattacgcagacaggaacactgcctacttctggaatcgcttcagcttctggaactacgcacggccgcccacggttatcctggagccccacgtgttccctgggaattgctgggcttttgaaggcgaccaaggccaggtggtgatccaactgccgggccgagtgcagctgagcgacatcactctgcagcatccaccgcccagcgtggagcacaccggaggagccaacagcgccccccgcgatttcgcggtctttggcctccaggtttatgatgaaactgaagtttccttggggaaattcaccttcgatgttgagaaatcggagattcagactttccacctgcagaatgaccccccagctgcctttcccaaggtgaagatccagattctaagcaactggggccacccccgtttcacgtgcttgtatcgagtccgtgcccacggtgtgcgaacctcagagggggcagagggcagtgcacaggggccccattaaacatgctgatttttggagtagaattga

SEQ ID NO: 29708 - DNA, 2421 bp, Homo sapiens
gagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcgggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatcgcttctacaagaaagcagctgcctttgtgttacgagcagttggtaaacattctccccagctagctcaggcaatagtcgattgtggagcactggatacgctggtcatatgcttggaagattttgaccctggagtcaaggaggctgcagcctgggcacttagatatattgcaagacataatgcagaactgtcacaagctgtggtggatgcaggagctgttcctcttttagtactctgtatccaggagccagaaattgctttgaaaaggattgctgcttcggccctcagtgatattgcaaagcattctccagagttagcacagacagtagtggatgcaggagctgttgctcatttagcccagatgatcctgaaccctgatgctaaattgaagcatcagatcctttcagctctcagtcaggtttcaaaacattccgtggatctggcagaaatggttgttgaagcagagatttttccagttgtacttacctgtctgaaggacaaggatgaatacgtgaagaaaaatgcttctactttaattagagagattgcaaaacatacacccgagctttcacagctggtagttaacgcaggaggggttgctgccgtgattgactgcattgggtcctgcaaagggaacacacggctgcctggcatcatgatgcttggttatgtagcagctcattctgagaacctagcaatggcagtcatcatttctaagggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaaagtaaaaaagccataaagaatatcctgcaaaaatgtacctacttaccagcccttgaaccatttctatatgatgctcctcccaatattctgaaacatgtggttggacagttcagtaaggtattattcccctggatattcagatacacttctgcagagggtggacagctatcaaccacttaataactgagcaaagttatattgtgatactcaaattcacagcagagtagttttgagtaacagtaattaaatccttctaaatatttgaactaagtatattctagatttatttaatgggaaatacctttagataatattttctaaatttatgtaatactttaaacattcgtagcttgaatatgtgaggaactattcatggtcattcgcatgcataggatttgttctacaggtagattttaaaaacacgttaaagggccttaaggcattttgttattctgttaaaaaccacacacactcgtacatgcagacacctccaatgagatatagttaagagatggcattcaaaaaccctaaattattctagccaatttgtcataggcataggcaaggaaagctggccttgctaactatatagtagtatacacaagagaaatctttgaaggaggaaactgatgacagatatacagggcacttgaaggagactctgatgctagttatataagtgcattaacttaagacacggactctgtgggtaacctgttaggttttactaagaatttaggaaaaatttactcctctttatcacaagttttccaaacctccttccccaccctatctaaagtgttccttacctttcatgggcccagcgagggtagaattcagaatagagagttatactcctgcatacatgctctccctctcattgaaaggtttcttagtctagctctgctcatgaatgaacaaagaagcaggcatgtaaaatggatccttgtcctaacgtcactttcccaagtttcaaaagtcacattttcaggtatttaaggaatagtttgaagctaataccatcaggctcagagtttacatgcatttttacttaggaagtggtaaacgggtgaaagagggtttcaataaaattttaaataaaaacagca

SEQ ID NO: 29709 - DNA, 1863 bp, Homo sapiens
aggttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcgggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaaagtaaaaaagccataaagaatatcctgcaaaaatgtacctacttaccagcccttgaaccatttctatatgatgctcctcccaatattctgaaacatgtggttggacagttcagtaaggtgctgccgcatgatagcaaagctcgacgactttttgtaacaagtggtggccttaaaaaagttcaagagataaaagcagaacctggttctctccttcaagaatacatcaacagtattaacagttgttaccccgaggaaatagtgaggtattattcccctggatattcagatacacttctgcagagggtggacagctatcaaccacttaataactgagcaaagttatattgtgatactcaaattcacagcagagtagttttgagtaacagtaattaaatccttctaaatatttgaactaagtatattctagatttatttaatgggaaatacctttagataatattttctaaatttatgtaatactttaaacattcgtagcttgaatatgtgaggaactattcatggtcattcgcatgcataggatttgttctacaggtagattttaaaaacacgttaaagggccttaaggcattttgttattctgttaaaaaccacacacactcgtacatgcagacacctccaatgagatatagttaagagatggcattcaaaaaccctaaattattctagccaatttgtcataggcataggcaaggaaagctggccttgctaactatatagtagtatacacaagagaaatctttgaaggaggaaactgatgacagatatacagggcacttgaaggagactctgatgctagttatataagtgcattaacttaagacacggactctgtgggtaacctgttaggttttactaagaatttaggaaaaatttactcctctttatcacaagttttccaaacctccttccccaccctatctaaagtgttccttacctttcatgggcccagcgagggtagaattcagaatagagagttatactcctgcatacatgctctccctctcattgaaaggtttcttagtctagctctgctcatgaatgaacaaagaagcaggcatgtaaaatggatccttgtcctaacgtcactttcccaagtttcaaaagtcacattttcaggtatttaaggaatagtttgaagctaataccatcaggctcagagtttacatgcatttttacttaggaagtggtaaacgggtgaaagagggtttcaataaaatttt

SEQ ID NO: 29710 - DNA, 2808 bp, Homo sapiens
aggttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcgggtgagcccggagcccgaacccccgtcgccccccgcgcactgagtccccgacgcctccgccccgctgccctgcccgtggagctcttggggagccgcagtgtggggaccggagttcgcaaaagcatccattcttttcagcgggtctttgggggtcaggccgagagggtgaagcttccagatggttgtgggaggtgcgcgttgtccctgtttccatcttcattgcacacaggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatcgcttctacaagaaagcagctgcctttgtgttacgagcagttggtaaacattctccccagctagctcaggcaatagtcgattgtggagcactggatacgctggtcatatgcttggaagattttgaccctggagtcaaggaggctgcagcctgggcacttagatatattgcaagacataatgcagaactgtcacaagctgtggtggatgcaggagctgttcctcttttagtactctgtatccaggagccagaaattgctttgaaaaggattgctgcttcggccctcagtgatattgcaaagcattctccagagttagcacagacagtagtggatgcaggagctgttgctcatttagcccagatgatcctgaaccctgatgctaaattgaagcatcagatcctttcagctctcagtcaggtttcaaaacattccgtggatctggcagaaatggttgttgaagcagagatttttccagttgtacttacctgtctgaaggacaaggatgaatacgtgaagaaaaatgcttctactttaattagagagattgcaaaacatacacccgagctttcacagctggtagttaacgcaggaggggttgctgccgtgattgactgcattgggtcctgcaaagggaacacacggctgcctggcatcatgatgcttggttatgtagcagctcattctgagaacctagcaatggcagtcatcatttctaagggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaaagtaaaaaagccataaagaatatcctgcaaaaatgtacctacttaccagcccttgaaccatttctatatgatgctcctcccaatattctgaaacatgtggttggacagttcagtaaggtgctgccgcatgatagcaaagctcgacgactttttgtaacaagtggtggccttaaaaaagttcaagagataaaagcagaacctggttctctccttcaagaatacatcaacagtattaacagttgttaccccgaggaaatagtgaggtattattcccctggatattcagatacacttctgcagagggtggacagctatcaaccacttaataactgagcaaagttatattgtgatactcaaattcacagcagagtagttttgagtaacagtaattaaatccttctaaatatttgaactaagtatattctagatttatttaatgggaaatacctttagataatattttctaaatttatgtaatactttaaacattcgtagcttgaatatgtgaggaactattcatggtcattcgcatgcataggatttgttctacaggtagattttaaaaacacgttaaagggccttaaggcattttgttattctgttaaaaaccacacacactcgtacatgcagacacctccaatgagatatagttaagagatggcattcaaaaaccctaaattattctagccaatttgtcataggcataggcaaggaaagctggccttgctaactatatagtagtatacacaagagaaatctttgaaggaggaaactgatgacagatatacagggcacttgaaggagactctgatgctagttatataagtgcattaacttaagacacggactctgtgggtaacctgttaggttttactaagaatttaggaaaaatttactcctctttatcacaagttttccaaacctccttccccaccctatctaaagtgttccttacctttcatgggcccagcgagggtagaattcagaatagagagttatactcctgcatacatgctctccctctcattgaaaggtttcttagtctagctctgctcatgaatgaacaaagaagcaggcatgtaaaatggatccttgtcctaacgtcactttcccaagtttcaaaagtcacattttcaggtatttaaggaatagtttgaagctaataccatcaggctcagagtttacatgcatttttacttaggaagtggtaaacgggtgaaagagggtttcaataaaatttt

SEQ ID NO: 29711 - DNA, 2605 bp, Homo sapiens
aggttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcgggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatcgcttctacaagaaagcagctgcctttgtgttacgagcagttggtaaacattctccccagctagctcaggcaatagtcgattgtggagcactggatacgctggtcatatgcttggaagattttgaccctggagtcaaggaggctgcagcctgggcacttagatatattgcaagacataatgcagaactgtcacaagctgtggtggatgcaggagctgttcctcttttagtactctgtatccaggagccagaaattgctttgaaaaggattgctgcttcggccctcagtgatattgcaaagcattctccagagttagcacagacagtagtggatgcaggagctgttgctcatttagcccagatgatcctgaaccctgatgctaaattgaagcatcagatcctttcagctctcagtcaggtttcaaaacattccgtggatctggcagaaatggttgttgaagcagagatttttccagttgtacttacctgtctgaaggacaaggatgaatacgtgaagaaaaatgcttctactttaattagagagattgcaaaacatacacccgagctttcacagctggtagttaacgcaggaggggttgctgccgtgattgactgcattgggtcctgcaaagggaacacacggctgcctggcatcatgatgcttggttatgtagcagctcattctgagaacctagcaatggcagtcatcatttctaagggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaaagtaaaaaagccataaagaatatcctgcaaaaatgtacctacttaccagcccttgaaccatttctatatgatgctcctcccaatattctgaaacatgtggttggacagttcagtaaggtgctgccgcatgatagcaaagctcgacgactttttgtaacaagtggtggccttaaaaaagttcaagagataaaagcagaacctggttctctccttcaagaatacatcaacagtattaacagttgttaccccgaggaaatagtgaggtattattcccctggatattcagatacacttctgcagagggtggacagctatcaaccacttaataactgagcaaagttatattgtgatactcaaattcacagcagagtagttttgagtaacagtaattaaatccttctaaatatttgaactaagtatattctagatttatttaatgggaaatacctttagataatattttctaaatttatgtaatactttaaacattcgtagcttgaatatgtgaggaactattcatggtcattcgcatgcataggatttgttctacaggtagattttaaaaacacgttaaagggccttaaggcattttgttattctgttaaaaaccacacacactcgtacatgcagacacctccaatgagatatagttaagagatggcattcaaaaaccctaaattattctagccaatttgtcataggcataggcaaggaaagctggccttgctaactatatagtagtatacacaagagaaatctttgaaggaggaaactgatgacagatatacagggcacttgaaggagactctgatgctagttatataagtgcattaacttaagacacggactctgtgggtaacctgttaggttttactaagaatttaggaaaaatttactcctctttatcacaagttttccaaacctccttccccaccctatctaaagtgttccttacctttcatgggcccagcgagggtagaattcagaatagagagttatactcctgcatacatgctctccctctcattgaaaggtttcttagtctagctctgctcatgaatgaacaaagaagcaggcatgtaaaatggatccttgtcctaacgtcactttcccaagtttcaaaagtcacattttcaggtatttaaggaatagtttgaagctaataccatcaggctcagagtttacatgcatttttacttaggaagtggtaaacgggtgaaagagggtttcaataaaattttaaataaaaacagcattagaattgtc

SEQ ID NO: 29712 - DNA, 853 bp, Homo sapiens
agaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcgggtgagcccggagcccgaacccccgtcgccccccgcgcactgagtccccgacgcctccgccccgctgccctgcccgtggagctcttggggagccgcagtgtggggaccggagttcgcaaaagcatccattcttttcagcgggtctttgggggtcaggccgagagggtgaagcttccagatggttgtgggaggtgcgcgttgtccctgtttccatcttcattgcacacaggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatcgcttctacaagaaagcagctgcctttgtgttacgagcagttggtaaacattctccccagctagctcaggcaatagtcgattgtggagcactggatacgctggtcatatgcttggaagattttgaccctggagtcaaggaggctgcagcctgggcacttagatatattgcaagacataatgcagaactgtcacaagctgtggtggatgcaggagctgttcctc

SEQ ID NO: 29713 - DNA, 691 bp, Homo sapiens
agagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcgggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaaagtaaaaaagccataaagaatatcctgcaaaaatgtacctacttaccagcccttgaaccatttctatatgatgctcctcccaatattctgaaaca

SEQ ID NO: 29714 - DNA, 2112 bp, Homo sapiens
aggttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcggagtcttgctctgttgccaggctagagtgcagtggcatgatctcggctcactacaacctccgcctcccaggttcaagcgattctcctgcctcagcctcctgagtagctgagactacagatggagtctcattcactctgtcacccaggctggagtgcagtggcaccatccttgcccactgcagcctccacctccccggatcaagtgattctcctgcctcagtctcccaaagtgctgggattaaagaggccttgtttatcagatattgtggcaactattcagactgctttaatttgtgaactctaaatttccatgcattcactcaccatggatctctggatacctaatggacaggcaggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatcgcttctacaagaaagcagctgcctttgtgttacgagcagttggtaaacattctccccagctagctcaggcaatagtcgattgtggagcactggatacgctggtcatatgcttggaagattttgaccctggagtcaaggaggctgcagcctgggcacttagatatattgcaagacataatgcagaactgtcacaagctgtggtggatgcaggagctgttcctcttttagtactctgtatccaggagccagaaattgctttgaaaaggattgctgcttcggccctcagtgatattgcaaagcattctccagagttagcacagacagtagtggatgcaggagctgttgctcatttagcccagatgatcctgaaccctgatgctaaattgaagcatcagatcctttcagctctcagtcaggtttcaaaacattccgtggatctggcagaaatggttgttgaagcagagatttttccagttgtacttacctgtctgaaggacaaggatgaatacgtgaagaaaaatgcttctactttaattagagagattgcaaaacatacacccgagctttcacagctggtagttaacgcaggaggggttgctgccgtgattgactgcattgggtcctgcaaagggaacacacggctgcctggcatcatgatgcttggttatgtagcagctcattctgagaacctagcaatggcagtcatcatttctaagggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaaagtaaaaaagccataaagaatatcctgcaaaaatgtacctacttaccagcccttgaaccatttctatatgatgctcctcccaatattctgaaacatgtggttggacagttcagtaaggtgctgccgcatgatagcaaagctcgacgactttttgtaacaagtggtggccttaaaaaagttcaagagataaaagcagaacctggttctctccttcaagaatacatcaacagtattaacagttgttaccccgaggaaatagtgaggtattattcccctggatattcagatacacttctgcagagggtggacagctatcaaccacttaataactgagcaaagttatattgtgatactcaaattcacagcagagtagttttgagtaacagtaattaaatccttctaaatatttgaactaagt

SEQ ID NO: 29715 - DNA, 1759 bp, Homo sapiens
gaagacttccgccccgcagaggacttgcctccaccgccacctgcaagtccgcccagctgtacttctgcgcaggctccaggagttgtttgctgtctctatggcaacccagtagctggagtctgaagatggagaccaacgagtctacggagggatcgcggtcgcggtcgcgatctttagacatacagcccagctccgaaggactggggcccacttcggaaccgtttccttcttcagatgacagtcccaggtcggccctggcagctgcaaccgcagcagctgcagcggctgcatcagctgctgcagctactgcagccttcaccactgccaaagcagctgcattatctacaaagaccccagcgccctgttctgagttcatggagccgtcctctgaccccagccttcttggggagccctgtgcgggacccggctttacccacaatatagcccatgggagtcttggctttgagcccgtctatgtttcctgtattgctcaggacacttgcactacaactgaccatagttctaatcctggccctgttccaggctctagctctgggcctgttcttggttccagctcaggtgctggccatggctctggctctggctctggtcctggctgtggctctgtccctggctctggctctggtcctggtcctggctctggtcctggctctggtcctggtcatggctctggctctcatcctggtcctgcctctgggcctggtccagacactggccctgactctgagctcagcccctgtattcctccagggttcagaaacctggtggcagatcgggtccctaactatacctcctggagtcagcactgcccctgggagccccagaaacaaccaccttgggaatttttgcaagtcttagaaccgggtgcccgaggactatggaaacccccagacattaaagggaagcttatggtttgctatgaaactttgccgcggggccagtgcctcctctacaactgggaggaagagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgagggaagcgtgaagccatgctggagatgctcctgcagcatcagatctgtaaagaggtgcaggcagaacaggaacccacaaggaagctcttcgaggttgagtctgtgacacaccatgactaccgaatggagctggcacaagcagggactcctgccccaacaaagcctcacgactaccgccaggagcaacctgagaccttctggatacagagggcaccacagctgccgacatggtggccattgcccacccaggtaccagcagcagaagactatctgacttggaaagaatgggggtttacaggagtccaggaggtcctttccgctctcctaagagccacacctggtgaatactcagtaaacatttgcggaatgaatgaacaccctgtctgcagcaggacatggacaaataggctctgccatcaggaaatgggaagcaagaaaacggtaactcaagaggacagaggctggtgaggaggtaaagcaggcccagtgaaatggacctgacagcccaaactgtcagagaggaggaaagcaggcatttgattttggtaattgtgccaaagctatgtaagagaataaatgccattgttttaaggaaa

SEQ ID NO: 29716 - DNA, 1600 bp, Homo sapiens
aacccagtagctggagtctgaagatggagaccaacgagtctacggagggatcgcggtcgcggtcgcgatctttagacatacagcccagctccgaaggactggggcccacttcggaaccgtttccttcttcagatgacagtcccaggtcggccctggcagctgcaaccgcagcagctgcagcggctgcatcagctgctgcagctactgcagccttcaccactgccaaagcagctgcattatctacaaagaccccagcgccctgttctgagttcatggagccgtcctctgaccccagccttcttggggagccctgtgcgggacccggctttacccacaatatagcccatgggagtcttggctttgagcccgtctatgtttcctgtattgctcaggacacttgcactacaactgaccatagttctaatcctggccctgttccaggctctagctctgggcctgttcttggttccagctcaggtgctggccatggctctggctctggctctggtcctggctgtggctctgtccctggctctggctctggtcctggtcctggctctggtcctggctctggtcctggtcatggctctggctctcatcctggtcctgcctctgggcctggtccagacactggccctgactctgagctcagcccctgtattcctccagggttcagaaacctggtggcagatcgggtccctaactatacctcctggagtcagcactgcccctgggagccccagaaacaaccaccttgggaatttttgcaagtcttagaaccgggtgcccgaggactatggaaacccccagacattaaagggaagcttatggtttgctatgaaactttgccgcggggccagtgcctcctctacaactgggaggaagagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgagggaagcgtgaagccatgctggagatgctcctgcagcatcagatctgtaaagaggtgcaggcagaacaggaacccacaaggaagctcttcgaggttgagtctgtgacacaccatgactaccgaatggagctggcacaagcagggactcctgccccaacaaagcctcacgactaccgccaggagcaacctgagaccttctggatacagagggcaccacagctgccgggtgtcagtaacatcaggacattggacacaccattccggaagaactgcagcttctcaacaccagtacccttgtctctggggaaacttttgccctatgaacctgagaattacccctaccaattgggagaaatatcttcccttccctgtcccggaggaaggctgggtggtggaggggggagaatgactcctttctgaggggtgaggagggaagtggggtatggaatatggaatctatttctgtctgcactagagaggtcgggaggaagttaattctcactgtacttgaagaggctttacataaagggttctctctc

SEQ ID NO: 29717 - DNA, 2481 bp, Homo sapiens
gccccgcagaggacttgcctccaccgccacctgcaagtccgcccagctgtacttctgcgcaggctccaggagttgtttgctgtctctatggcaacccagtagctggagtctgaagatggagaccaacgagtctacggagggatcgcggtcgcggtcgcgatctttagacatacagcccagctccgaaggactggggcccacttcggaaccgtttccttcttcagatgacagtcccaggtcggccctggcagctgcaaccgcagcagctgcagcggctgcatcagctgctgcagctactgcagccttcaccactgccaaagcagctgcattatctacaaagaccccagcgccctgttctgagttcatggagccgtcctctgaccccagccttcttggggagccctgtgcgggacccggctttacccacaatatagcccatgggagtcttggctttgagcccgtctatgtttcctgtattgctcaggacacttgcactacaactgaccatagttctaatcctggccctgttccaggctctagctctgggcctgttcttggttccagctcaggtgctggccatggctctggctctggctctggtcctggctgtggctctgtccctggctctggctctggtcctggtcctggctctggtcctggctctggtcctggtcatggctctggctctcatcctggtcctgcctctgggcctggtccagacactggccctgactctgagctcagcccctgtattcctccagggttcagaaacctggtggcagatcgggtccctaactatacctcctggagtcagcactgcccctgggagccccagaaacaaccaccttgggaatttttgcaagtcttagaaccgggtgcccgaggactatggaaacccccagacattaaagggaagcttatggtttgctatgaaactttgccgcggggccagtgcctcctctacaactgggaggaagagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgagggaagcgtgaagccatgctggagatgctcctgcagcatcagatctgtaaagaggtgcaggcagaacaggaacccacaaggaagctcttcgaggttgagtctgtgacacaccatgactaccgaatggagctggcacaagcagggactcctgccccaacaaagcctcacgactaccgccaggagcaacctgagaccttctggatacagagggcaccacagctgccggtgtgtgagggtgactaggtgttgggggcagagcggggcaggaaaggtagggcagagttgttttgttctggcttggggagagtgggatccatcctcatcctggcactcctccagggtgtcagtaacatcaggacattggacacaccattccggaagaactgcagcttctcaacaccagtacccttgtctctggggaaacttttgccctatgaacctgagaattacccctaccaattgggagaaatatcttcccttccctgtcccggaggaaggctgggtggtggaggggggagaatgactcctttctgaggggtgaggagggaagtggggtatggaatatggaatctatttctgtctgcactagagaggtcgggaggaagttaattctcactgtacttgaagaggctttacataaagggttctctctcatcccaagactgctaatttagtgattctgtgagtcactgtgtgcataccccataacctttccttgggattgcccctatcccacactatgacatcagaactttttttattattgttttatatttgaccaaaatattctggtttagatacagatatttacagaaagtagggaggaaggggaccaagccagagagggacaggtatatgtacagggctgagctgcagagggctacaacttccatataaggtaggtttttttgtggctgttttccattgcatatgaaaatgtccatttctggtgtgtgcagacatggtggccattgcccacccaggtaccagcagcagaagactatctgacttggaaagaatgggggtttacaggagtccaggaggtcctttccgctctcctaagagccacacctggtgaatactcagtaaacatttgcggaatgaatgaacaccctgtctgcagcaggacatggacaaataggctctgccatcaggaaatgggaagcaagaaaacggtaactcaagaggacagaggctggtgaggaggtaaagcaggcccagtgaaatggacctgacagcccaaactgtcagagaggaggaaagcaggcatttgattttggtaattgtgccaaagctatgtaagagaataaatgccattgttttaagga

SEQ ID NO: 29718 - DNA, 8273 bp, Homo sapiens
agttggtgcagcggcggttggggtgagagcgcctacgccacccctcccctcctccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggtcagcaatagtcctgaacctcagaaggctgtagaacaggaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaacaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccaacactttaggaggctgaggcagatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcaccacattggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 29719 - DNA, 4761 bp, Homo sapiens
agttggtgcagcggcggttggggtgagagcgcctacgccacccctcccctcctccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaacaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataa

SEQ ID NO: 29720 - DNA, 1908 bp, Homo sapiens
tcccttaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaaaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtgctgcactccagcctgggtgacggagcaagaccctgtctcaaaacagacaaacaagcaaaaaatagattaaagtctggatttcactga

SEQ ID NO: 29721 - DNA, 7305 bp, Homo sapiens
tcccttaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttgtgccaactcgtttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaacaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccaacactttaggaggctgaggcagatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcaccacattggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 29722 - DNA, 7335 bp, Homo sapiens
agtgttaaggtcagcaatagtcctgaacctcagaaggctgtagaacaggaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaacaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccaacactttaggaggctgaggcagatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcaccacattggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 29723 - DNA, 4659 bp, Homo sapiens
gtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttgtgccaactcgtttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaacaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctga

SEQ ID NO: 29724 - DNA, 4949 bp, Homo sapiens
gcataaatgctaggagcagcagctctatggttatgaggtggggagaacggaatgacgtcatcgcttgggagctgctgcaggatggagtggaaagctgctgctgatggcattgtttttgtggcagcaagctgaatgacagatcctcactacaaagatacccctttggcccccgtgtaggcctccttggttcgggtgtttcaccatgccagcacagcgccatgagtcctggatgcatgctgctgtttgtgtttggctttgttggcggggcggtggtcattaattctgctatcttagtatctctctctgttttgctgcttgtgcacttttctatttctaccggtgtgccagctctgacgcagaacctaccaaggatactcagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaaccgtaatcctccaccagggacgtttactggggctgagggcaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccatt

SEQ ID NO: 29725 - DNA, 3139 bp, Homo sapiens
ataaatgctaggagcagcagctctatggttatgaggtggggagaacggaatgacgtcatcgcttgggagctgctgcaggatggagtggaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaacaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatg

SEQ ID NO: 29726 - DNA, 1013 bp, Homo sapiens
ggtgagagcgcctacgccacccctcccctcctccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagagcgccatgagtcctggatgcatgctgctgtttgtgtttggctttgttggcggggcggtggtcattaattctgctatcttagtatctctctctgttttgctgcttgtgcacttttctatttctaccggtgtgccagctctgacgcagaacctaccaaggatactcagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggtcagcaatagtcctgaacctcagaaggctgtagaacaggaggtgagaatggtgcttcttaacattttgcaaaaagtatactaa

SEQ ID NO: 29727 - DNA, 1431 bp, Homo sapiens
ctgcgcttgcgcgctggggacaaccgttgctgggtgtcccagggcctgaggcaggacggtactccgctgacaccttccctttcggccttgaggttcccagcctggtggccccaggacgttccggtcgcatggcagagtgctacggacgacgcctatgaagcccttagtccttctagttgcgcttttgctatggccttcgtctgtgccggcttatccgagcataactgtgacacctgatgaagagcaaaacttgaatcattatatacaagttttagagaacctagtacgaagtgttccctctggggagccaggtcgtgagaaaaaatctaactctccaaaacatgtttattctatagcatcaaagggatcaaaatttaaggagctagttacacatggagacgcttcaactgagaatgatgttttaaccaatcctatcagtgaagaaactacaactttccctacaggaggcttcacaccggaaataggaaagaaaaaacacacggaaagtaccccattctggtcgatcaaaccaaacaatgtttccattgttttgcatgcagaggaaccttatattgaaaatgaagagccagagccagagccggagccagctgcaaaacaaactgaggcaccaagaatgttgccagttgttactgaatcatctacaagtccatatgttacctcatacaagtcacctgtcaccactttagataagagcactggcattgggatctctacagaatcagaagatgttcctcagctctcaggtgaaactgcgatagaaaaacccgaagagtttggaaagcacccagagagttggaataatgatgacattttgaaaaaaattttagatattaattcacaagtgcaacaggcacttcttagtgacaccagcaacccagcatatagagaagatattgaagcctctaaagatcacctaaaacgaagccttgctctagcagcagcagcagaacataaattaaaaacaatgtataagtcccagttattgccagtaggacgaacaagtaataaaattgatgacatcgaaactgttattaacatgctgtgtaattctagatctaaactctatgaatatttagatattaaatgtgttccaccagagatgagagaaaaagctgctacagtattcaatacattaaaaaatatgtgtagatcaaggagagtcacagccttattaaaagtttattaaacaataatataaaaattttaaacctacttgatattccataacaaagctgatttaagcaaactgcattttttcacaggagaaataatcatattcgtaatttcaaaagttgtataaaaatattttctattgtagttcaaatgtgccaacatctttatgtgtcatgtgttatgaacaattttcatatgcactaaaaacctaatttaaaataaaattttggttcagga

SEQ ID NO: 29728 - DNA, 1580 bp, Homo sapiens
agaaaacaatatggccgctcccagctgggacgtgagtctctggattaggcaggcagaggcagttatgggcttctgcagtggcgagaaaggaagcgcctgaagggtcgtgaggctggggcgggacccggcaccgctggggcggccaggccgtgaggacgccaatggcgagcagcgtggacgaggaggcgctgcaccagctgtacctgtgggtagacaacatccctctgtcccggcccaagcgaaacctctcccgggactttagcgatggagtccttgttgcagaggtcatcaagttttacttccccaagatggtggagatgcacaattatgtccccgccaactctctccagcagaagctcagcaactggggtcatctgaacaggaaggtactgaagaggctgaacttttcagtaccggatgacgtgatgcgcaagatcgcgcagtgcgccccaggcgtggtggagctggtgctcatcccgctgaggcagcgcctggaggagaggcagaggcgcaggaagcagggcgccggctccttacaggagctggctccccaggatggcagtggctacatggatgtgggtgtatcccagaaggcccgaggtgaaggtgtcccggacccccagggagggggtcagctcagctgggaccggccgccggcgcctcggcctccagcgtataaccgggcgttgcagggcgaccccagcttcgtcctccagatcgctgaaaaggagcaggagctgttggcctctcaagagaccgtgcaggtcctgcagatgaaggtaaggcgcctggagcacctgctccagctcaagaatgtgcggatcgaagacctctcccggcggctccagcaggcggagcgtaagcagcggtgagcggcggcccgggccgcgcggggacgcccgggtacccgccagagccccgacgccgcgccggacccacccaccgatggatagaccattgggagggcggagcccgctgctctcacgagcctgctggggcccgagtgccctccttccttgggatgggtgagcgtgggaggagatgggacaggaactctaggagcgcaggcccgggactgagccgcctcctaccactccggagatccgggtcaggagaatggaccgctttccagagcccagaagccacgtgcagagacctagcctgtcccccaaagcagtgtccaacaccttgggcccggccttgcatctcccggcgctgggccttggggggcggtcccttggctctgtccacacccccagaatcaggtccccgcccagctccgaggacggcggcgtctccatccaggctagttccccatgccctcagccatgggggaatctgtcccgggccgctgaggggctcccctgcccctcctgggagcttacctgggacccacctcggcgacggagaccgcagcagctggagaggaaggggtgaggcgtgggatcgccaggagtagggaggacatcgacgatgtgcccgtagcagtcgcccctccctcctcgcgcacggggtactgaggcggaaggtttgaaggttacggctcagggctgccccattaaagtcagtgttgtgttcta

SEQ ID NO: 29729 - DNA, 775 bp, Homo sapiens
ggttcagaaggctttggcttctgatagtcatggactcactaggctgctgaggaagatcaataatacctactggaatcagtcatgagaagtcaagcatggaaattgtgaattgtgtgtgtggccagaccagtacctccaagtgttcagaagatgtgtgaccagacaaaacacagtaaatgctgcccagcaaaaggcaatcaatgctgcccaccacagcagaaccagtgctgccagtcaaaaggcaatcaatgctgcccaccaaaacagaaccagtgctgccagccaaaaggcagtcaatgctgcccaccaaaacacaatcactgctgccagccaaaacccccatgctgcattcaggccaggtgctgtggtttggagaccaagcctgaagtctcaccccttaacatggagtctgagcccaactcaccgcaaactcaggacaagggctgtcaaacccagcagcagccccatagcccacaaaatgagtccaggccaagcaaatgagagcagaagaagtcaaacaaagaagaagtccctggggccatgcctttcactttgtagggtgggggattactgagagtcaggctagacctgtgtttagagaagcagttttcacagtgactaccatttccacccaatgagaggctcctatttcccatcatagctccctaccctagggaggcctccatctggaaatgggaggatgaagaggctagaatcatctttcctagtgatcctgacatttagacagcacagaaataaagagcaataaaaagaa

SEQ ID NO: 29730 - DNA, 691 bp, Homo sapiens; identical to SEQ ID NO: 29572

SEQ ID NO: 29731 - DNA, 3335 bp, Homo sapiens
gcgccaccagggcagcagccgccgcagccgccgccgctgggcagaggagccggagacgcgagcgggcgaggtggcggcggcggcggagcgggagcgggtaccgggcgcgggcagagcgcggcggcgcggagacggggttttgccatgttgacctggctggtctcgaactcctgaacgcaagtgatccgcctgcctcagcctcccaaggtgctgggattacaggcacgagccactgtgcctggcctcaactgttgcttcttataaaggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggccagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacagagtactgcctggttcctgatgcagtcactgattcttagttgattgatatgtatttgccccagggcactttaatttgggctgtagttattttttttaatacaatagagacttttcatttaactttaactttgtaaatattgaagtgtgtaataaagccaataaaatatgggtttgaatattgttttagcttattatttttgatatgttttggtatcaaattacaaggaattgaaaactaataacttagccctagaagcccattcacttgtaagcaaagtgctaaaacaaagcaaaggtgattgttagtttgagccagtctactcactttgtaagccctttgtactcctgttgtacaagggccatccccatgataaaggttccattctgttatttgagcattgcttattaaaatgatggcactacccagagatggggaaggagaatgtgattatcctagtttatgaatttccaagtttttaaaaataataaattaatcaatcaatc

SEQ ID NO: 29732 - DNA, 2990 bp, Homo sapiens
ccggagccgcgagcgccaccagggcagcagccgccgcagccgccgccgctgggcagaggagccggagacgcgagcgggcgaggtggcggcggcggcggagcgggagcgggtaccgggcgcgggcagagcgcggcggcgcgggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgataaacaagaacaaaagaggcaagactgttcataaaaaattgagaatgttttagtttgcgatggacttcaaaacaaaatatttaccatgtactaacatataatttcatagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggccagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacagagtactgcctggttcctgatgcagtcactgattcttagttgattgatatgtatttgccccagggcactttaatttgggctgtagttattttttttaatacaatagagacttttcatttaactttaactttgtaaatattgaagtgtgtaataaagccaataaaatatgggtttgaa

SEQ ID NO: 29733 - DNA, 2751 bp, Homo sapiens
gcgccaccagggcagcagccgccgcagccgccgccgctgggcagaggagccggagacgcgagcgggcgaggtggcggcggcggcggagcgggagcgggtaccgggcgcgggcagagcgcggcggcgcgggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaagtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagctttacagttcaccattaactgtagaactataaaatgatttctgaagtgtcaagataaatgttaattctgaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggccagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaa

SEQ ID NO: 29734 - DNA, 6290 bp, Homo sapiens
ccggagccgcgagcgccaccagggcagcagccgccgcagccgccgccgctgggcagaggagccggagacgcgagcgggcgaggtggcggcggcggcggagcgggagcgggtaccgggcgcgggcagagcgcggcggcgcgggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggccagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacagagtactgcctggttcctgatgcagtcactgattcttagttgattgatatgtatttgccccagggcactttaatttgggctgtagttattttttttaatacaatagagacttttcatttaactttaactttgtaaatattgaagtgtgtaataaagccaataaaatatgggtttgaatattgttttagcttattatttttgatatgttttggtatcaaattacaaggaattgaaaactaataacttagccctagaagcccattcacttgtaagcaaagtgctaaaacaaagcaaaggtgattgttagtttgagccagtctactcactttgtaagccctttgtactcctgttgtacaagggccatccccatgataaaggttccattctgttatttgagcattgcttattaaaatgatggcactacccagagatggggaaggagaatgtgattatcctagtttatgaatttccaagtttttaaaaataataaattaatcaatcaatcaccctctcttgttcttgtggccttcttcactctgtaagatattgtgttcactccctggcttttttcatgcagatagaagattagtgattttgctgggattcattgaagggtctcctttcctcttcaattacatcagaatctaaagcagcaacagggtccccataaaaacttgctcttcgattgtcccagttcttgttgagtgctgctgtgaaaagtgacaggtttcagccatgggtcagcatttctttttaagacacctgatgatgctggtggaaatggatcagtgggtaacattgtgctgttctgtaaagggtgcagacctaagtcctccacttgcattctcaccttgtttggaaagccaatgatgttactaggtcaatggtttcattaaggtactcacccccatgaaggagcagcagtgtggtcccctgtcaatatttataaggcaccatgtcttaaaaatgtctgtttttagtatgaattagctttcattttccctattcagttctgcttttgggaacttgacagggcccatccatgagaatgggcttcacaaaatatggcaaatgtatgtaccaaattccttcgggaccactaaataaaggtgaaatgggcaatgtacaacaaatgttagtgtcacttctcagatatatattacacaatgattagtttgtttcttctccttggtcttttgtctttattagtggtgggtgatactttaataaaacctcatcacttgctggaaatagctgtaacttatcattctcatcctgtgcattagtggctagacataaacaagagggcccatttcagctgggagttttcatgtttcattgatgcgttttgctgacctatggatgaaacagagccatcactgagaagaaaaagcatggctgatagtgtccagtttttattaattaaatctttacagtagtcctcattgtctttggaatactattaattggcagctgcggctgtattgttatttgaaattggtcatcaaatttggattccacgttggaatctctagatatttctcgttagaaaattcttttgaagtagctgactctgcttcataactcacgcgctctgtaatggtgaaaagggagctgtgctgttttccaacatgatggcagtcatttcaaatggtttctaccaagtcttttttttttttttttaattttgttgtttgttggaagttactaaccatgttgtaaacctgcccagttgctgcaaacttttacatttctctgctttacttaaaataatcgagctgtcagtcctttgttagaagtggtaaccatgcaagttcaactgtttaaattctgtaatgaattaagtgtccccccacctgttgcccttcccacccttccattttgtaatgaaaattccacttacagctgaaagagcagagaaatataaatgaagctcttggcttcaccaaattgcctgagattaacatgaagttttgcttctctgctcttttctccactgtaggtggttttttcattgacagcccctattgccagcctctgagcgtcgcaccatttattattcacttgggccctcaagatttcttctctgacttctagaaccatcaggttgtctggcttgaaatggcaatttctatgtcttggtcttaagagcaatgtgacaccctgaggctatccagctttcagacactccactctgacaccctctttttgaaagcaatgactgatcattttaaagaagagcaatactttgttcaaagccacggtgtctgttttaaaacttttcctttggaaacctagcaatatctgtacttaacccctttttagcatagtttcttgtcagggagtttacaggtcagtgtagagcttaaaattagcgtgtgagctgtgctatgttctgacagttttttacactttttagcacataaatagttacattcctgactgcgtcagttagcgttactataatttctcagagataggggtcctccttgaagccatatcctctgcacggggactggcccctagccagggatgtggcttgcagcttgtgtttcttcaggctgcaggagtaccccatctcttgtgcaaggtaattggtccagtagatttccaacatacctcatgctgactagatgaagtgcatgggtggtgaagtaaggagttgagtttatatagttctgaagtcgtttgtagtctctctcaaattgttagcctggggaacaaaccactgagagattttgctggtattggccttttctttttttttttttttttaattttgggtgaatgtttgaaaatcatgaatcagccaccattattaattgaagagctgggaatacctcgttaatgtatttttaaaactggtgttggaccctctgtgtatttcaggttaatacttttaagcagttttcagcacgtttatctcactttattctcgttctcctcggaccttcgtagccatatcacttgtataaaataggctgagatatagtgactgtaagctgtgatctcagtatacaaaggtaagctcttttattttctgattaaagagaaaaatagtcaattaagacaacatgcatatatgacaatcatatatgatgtatttgatctcttaggtcatatgtcatcgcattacctttaaaaattgtatggtctaaatgtaaaatagttatttttcaacatttgttttaatacccttgtaactgctttttactcaagacagacatttcacttacactaagtgtgtgtgtgtgtgtgtgtgtgtgtagaaacttaggatataacacgtatgtaaattacacacacatacctgtttaaatgtaagaattcagtgataggaacagttcatctaagaagattttaatgacagggcactcttttggccaaagcagtggaatttcctaagcagcaaggttggtaatagtgctggtaggatctgtatgtgtaagctgttacacaagctgaggatcaaagtgccaatttctcaaggagaaaaacttctccgagaaatgaaagtctctgatctgtgttgtatgccctaatacaacaacagcaagaagccatagaaaaaagcaatagaaaatg

SEQ ID NO: 29735 - DNA, 832 bp, Homo sapiens
gctttgtcacgctggctggagtacagtggcgcaatctcggctcactgcaatctccgcctcccaggttcaagcaattctgcctcggcttcctgagtagctgggactacaggtgcgcaccaccatgcctggctaatttttgtatttttagtagcgtcggggtttcaccatgttggccaggctggtctcgaactcctgacctcaggtgatccacccgccttggctcctaaagtgctggaattacaggtatgagccactgtgactggccgcaggtggtctgattctagtcctggctctgtcgcagactagctgcttgatctcaggaaatgtctctatttctagattgtcttcaatgttcttatcctgcttatctgtggataatattcttgatagtcatgtgaaggatctatcttgggaaagccaaggacatctgggaatgtttgacaggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaa

SEQ ID NO: 29736 - DNA, 1954 bp, Homo sapiens
agactctgcaccctccttcagcccaggcaaggcctggggccctgggcagcctccaggtgcagtgccctcccgtgggccgcacccttgccactgccccagggcatgtctctactcaccaattatgaagggcttcggcatcagatagagaggctggtgcgggaaaatgaggaactgaagaagttggtgcggctcattcgggagaatcacgagctcaagtcagcgatcaagactcaggcaggcgggctcggcatcagcgggttcacgagtgggcttggtgaggcaacagcaggcctttcctcacgccagaacaatggtgtcttcctgcccccgtccccagcagtggcaaacgaacgagtcctcgaagaagtggggatcatggccttggcacccctggccgagatgctaaccagcttgcagcccagcgccacaccgggctcactcatgagccccctgacaggcaccctcagcacgctgctgtctggcccagcacccacgtcacagagcagccccctcaccagcttcctgaccagtcccattgcgggacccctaacaggcacactggccagttccctgggcctgccctccactggcaccctgactcccagcagcctcgtggcaggccctgtggccatgtcccagagcagccccctgatagcccctgtgatgggcacggtggctgtctctctgagcagccccctcctcagctccactgccaccccaccaggggtctctcagaacctgctggccaaccccatgagcaacctggtcctgccagaggccccaaggctgcggctggctgagccactccgcggaggccccactgggccccagtccccagcttgcgtggtacccactgccaccaccaaagtcccactctccactgagcccccccagtcgacccaggacccagagcctctcagcatggcgtttgcaggagcacccctccagacctccacccctatcggagccatgggcacacctgctcccaagacggccttctccttcaacacttcggacacacaggcccagcccagtgccgcccaggaacaagtggtccctgcatctgtccccacctcccccaccacctcccccacggtcaccgtccttgcctctgcccccgcccttgccccccaggttgccaccagctacacaccctcaagcaccacccacatcgcccagggtgccccccatcccccttcccgaatgcataattccccaacccagaacctgcctgtcccccactgtcctccacacaacgcccactccccacctcgtacctcatcctccccggcttcagtcaatgactctcgaggtccacgcaccacagaaccgtcgacgaagagcatgatggaggtggaacggaagctggcccaccgcaagaccagcaagttccccgagaacccccgagagtcgaagcagctggcctgggagaggctggtgggtgagattgccttccagctggaccgcaggatcctgtccagcatcttcccagagcgcgtacggctctacggcttcactgtctccaacatcccagagaagatcatccaggcttccctgaaccccagtgaccacaagctggatgagaagctgtgccagaggctcacacagcgctatgtgagcgtcatgaacaggctgcagagtctgggctacaacgggcgggtgcaccctgcgctgaccgagcagctggtgaacgcttatggcatcctgcgagagcgcccggagctggcggcgtctgagggcggcccctacaccgtggacttcctgcagcgtgtggtggtggagaccgtgcaccccggcatgctcgccgacgcgctgctgctgctctcctgcctcagccagctggcgcacgatgacggcaagcccatgttcatctggtgacgctggagctgggaggtccaggctcgctcagccccacagccctgtgcacggccattaaagcttcccacagacactg

SEQ ID NO: 29737 - DNA, 1795 bp, Homo sapiens
ctccttcagcccaggcaaggcctggggccctgggcagcctccaggtgcagtgccctcccgtgggccgcacccttgccactgccccagggcatgtctctactcaccaattatgaagggcttcggcatcagatagagaggctggtgcgggaaaatgaggaactgaagaagttggtgcggctcattcgggagaatcacgagctcaagtcagcgatcaagactcaggcaggcgggctcggcatcagcgggttcacgagtgggcttggtgaggcaacagcaggcctttcctcacgccagaacaatggtgtcttcctgcccccgtccccagcagtggcaaacgaacgagtcctcgaagaagtggggatcatggccttggcacccctggccgagatgctaaccagcttgcagcccagcgccacaccgggctcactcatgagccccctgacaggcaccctcagcacgctgctgtctggcccagcacccacgtcacagagcagccccctcaccagcttcctgaccagtcccattgcgggacccctaacaggcacactggccagttccctgggcctgccctccactggcaccctgactcccagcagcctcgtggcaggccctgtggccatgtcccagagcagccccctgatagcccctgtgatgggcacggtggctgtctctctgagcagccccctcctcagctccactgccaccccaccaggggtctctcagaacctgctggccaaccccatgagcaacctggtcctgccagaggccccaaggctgcggctggctgagccactccgcggaggccccactgggccccagtccccagcttgcgtggtacccactgccaccaccaaagtcccactctccactgagcccccccagtcgacccaggacccagagcctctcagcatggcgtttgcaggagcacccctccagacctccacccctatcggagccatgggcacacctgctcccaagacggccttctccttcaacacttcggacacacaggcccagcccagtgccgcccaggaacaagtggtccctgcatctgtccccacctcccccaccacctcccccacggtcaccgtccttgcctctgcccccgcccttgccccccaggttgccaccagctacacaccctcaagcaccacccacatcgcccagggtgccccccatcccccttcccgaatgcataattccccaacccagaacctgcctgtcccccactgtcctccacacaacgcccactccccacctcgtacctcatcctccccggcttcagtcaatgactctcgaggtccacgcaccacagaaccgtcgacgaagagcatgatggaggtggaacggaagctggcccaccgcaagaccagcaagttccccgagaacccccgaggcttccctgaaccccagtgaccacaagctggatgagaagctgtgccagaggctcacacagcgctatgtgagcgtcatgaacaggctgcagagtctgggctacaacgggcgggtgcaccctgcgctgaccgagcagctggtgaacgcttatggcatcctgcgagagcgcccggagctggcggcgtctgagggcggcccctacaccgtggacttcctgcagcgtgtggtggtggagaccgtgcaccccggcatgctcgccgacgcgctgctgctgctctcctgcctcagccagctggcgcacgatgacggcaagcccatgttcatctggtgacgctggagctgggaggtccaggctcgctcagccccacagccctgtgcacggccattaaagcttcccaca

SEQ ID NO: 29738 - DNA, 2413 bp, Homo sapiens
ccaggaagtgggtacacctgtccccacccccacagtaggagtcagaatcagggactggaagggatggggttcctggaggaagctcacagcagcagcagcctctgagtcacaactcagcccctccctggcatatccctttgtttgctgggagttgagctgtgactcacaaaggctctggtcccgggctgggcccatgtgacccagggtcctgactgccctgcccacagtcactgagaaaattctttgtgcaggctcaccttcccctcatctcccccactcttcctgatcctgcagcgtcagatcccagcctgcagtatcagacctcaaaaggagcctctggtgtcttccaaaagggaaggaaagagagagaaagccactggagttgggcagcgtgggaagctgtgaaagtggacaagcgtgaaagagcttccaagtagtggaaacagcagaagcaaagatgtgaacatgggaaaacctctgcagtatctgggtgactgtggggtttggctctgtttgagcaccccgggatgattggtggtggggtgtggctgaaggtgaattggaacagtgcactcagagccaggttgcaagagtgctgcatgctcctcagggattggctccggccaagtgccccagcctccttttctggagaattctgtttttgacttgggccccatgtccagttctgctctgacttgtgggtccaccttagaaaagtcaggagacacctgggaaatgaaggcactagactcttccagactcgttccatggccacccagaggccttgggtcatccacccaacatcccaacaaaccccactgtgcactggcatcatgccagggtccaggtgtcctgccaggagcagcctctgccctcccagagctgacatttcagggggatgtgtgccaaagtgagacctgtcagagatatttacaagcagccatctctcttgacatcgctgtatcccaaataaatcttctgggaagaccctcttcacctccagctctcctgatacagcaaggcagttgtgagcaagttattcataactctacacctcaatttcttggtatggaagatggggataatgagaggaccacaggatggttgtggagactgtgtgaggatatagatgccgagcccagtagcacagggtgcagccgttcaaaccaactgacatttactgagggctgctttgtcaggtccctctctacagtatactccaacacacacatacacacacatctgtaatcaataataatcctgcaacatctgagagtctggcagctgtttgtctgggcctttgcacatgctatgccctcccttccatcccccacccccaccaggggtgactcgtagccatccctttctgcatcttcttagatatcactttttccaagaagcctccctgtcacacttccccaatatcacagatgaagaaatcaagattcagaaaggttaagttactggcacaaggtcacacaatccagatctcatactcttagcccccggggaaccttcactgtattaaatgacatcaattgatcaatcaatcgatcaatcaatgaaagagtgggaggcatgcatctcctgatccccgatcctatacattttcatctctttattgtttctatcaaagcctgctaagtaattactttccctctgggtaagtgccactaggtgatgaggtgaggtaatcaaatgacatagaagaggaaggagtccactgccagggtaggtgcagtggagcaagtcttacaatgtgcaggattataactccagcaatgacccctaggctcatgctcattccccaggtggcagtttcagaacacattgctcaggtctcaccctgtaaatgtaggtaccagccttctagttgaccatcagaacacacaacgccaagatcttactccagccacctgccaggacctggagggcaggaggagagttctgcctacattgtctcattttccctccccttctgcagtgagatagaccatgtccagtgctcaggagttgactggccacactggggagtttgaccacaacattgggctccatatgcatggaatgaggttgcatgcaattgtccatgaggctgctccctcatttgtctgggtttctgctccaatgctatctcctcagaaagaccttctctgactgaagccagctctgcctccatcccatcactctggatctccttccccagcttcatctccattacactggccactctccctcacatcttattactgatctagttgtctactgtccatctccaccactgggatgtaaactccacaagggaggaatgctgtcagtttctttgactgctgtgtggtcagtaccagggcaatgcctcgcacagagtagccctctctccctaaatgtttttgaataaatgaaataaatgagc

SEQ ID NO: 29739 - DNA, 2080 bp, Homo sapiens
gtgatgcttggggaccggctcctcggtcacaccccagtcctgctctgaaggttgccgttttccaaacagaaggatggtagctagaggggagatagcaagattctggagtctggaaagccttcacttggggtgctttcatgtatcatcattccacttgaggctcaaagcacaccaataacaagtacttgttcagaatgtataaacaaccctgagagatgggttttatcatccacattcaacaggtgaaaaaacaaagaaagaaacttgaccaaggactcatactcaaaaaagaaaaatatagaaaagaaaaaaaatgtgcatcgctatcatttgaagtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagattgcgagtgaatcaggaagagctgtcggaaaactccagcagcacccccagtgaggagcaggacgaggaggccagccagagccgccacagacactgtgagaacaagcagcagatgcggaccaacgtcatccgggagatcatggacaccgagcgggtgtacatcaaacacctcagggacatctgtgagggctatatccgacagtgccgcaagcacacaggaatgttcaccgttgcgcagctagccactatttttggaaacattgaagatatttacaaattccaaagaaagtttctgaaagaccttgagaaacagtacaacaaagaggaacctcacttaagtgaaataggatcttgctttcttcaaaatcaagagggctttgccatctattccgagtactgcaacaaccacccgggcgcctgcctggagctcgccaacctcatgaagcagggcaagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatcc

SEQ ID NO: 29740 - DNA, 6665 bp, Homo sapiens
gtgtgcgttgcgctttctcccgcgatcgccctgccggtcgctagctccgagggcgcgcactggatcccaggctcctccgagagtgcggcgacctcggggctccgccggcaccggaggtggctctgagggcagggacgtgttggacacgctgactttgtaggctccgccaagaggcgccgcaggaggtcgtccctgatggcccctggaggcgaagctcatcacaggatgaggaaaggacagaggcacagagaacccccaagaggagatggggctctgggagacggccaaggcctcggccattctctgactacggccagctggccagccgcagtttgtctattcctgaagactcggttgctgcagacccccagaaggaagaccgtgtggacgaggacccccaggcaagcatgacttctgccagccctgaagaccagaatgctccagtgggctgccccaaaggagcccggagaaggcgccccatttccgtgataggtggggtcagcttgtatgggaccaaccagacggaggaactggacaatcttctgacccaaccggcttccaggccgcccatgcctgctcaccaggtgccaccctacaaggctgtgtcggcccggttccggcccttcacattctcccagagcacccccattgggttggaccgtgtgggacgccggcggcagatgagagcatccaacgtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagattgcgagtgaatcaggaagagctgtcggaaaactccagcagcacccccagtgaggagcaggacgaggaggccagccagagccgccacagacactgtgagaacaagcagcagatgcggaccaacgtcatccgggagatcatggacaccgagcgggtgtacatcaaacacctcagggacatctgtgagggctatatccgacagtgccgcaagcacacaggaatgttcaccgttgcgcagctagccactatttttggaaacattgaagatatttacaaattccaaagaaagtttctgaaagaccttgagaaacagtacaacaaagaggaacctcacttaagtgaaataggatcttgctttcttcaaaatcaagagggctttgccatctattccgagtactgcaacaaccacccgggcgcctgcctggagctcgccaacctcatgaagcagggcaagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtcaagacggggttgacacaatgctgcacgtgtctggtcacacttagaaattgagctcttactctcttctgtaatactgggggacctacagctgccgtggggctgaccacggtgttccctggcatcgtctgtgtccacacagatgctaactggtagtgcaaatgtcatcctgcaaggttcctcttcctgcaagcaaagtggagagaaagaagatgcatctgtcaccttcatcagggtcctcagtgcagagcaacttacgcatcctcaagaatccactgcttttcaggcaaggagggagaaatcctgctgcacactggctttgtcccggagtcggattccctcctgcctgcacgccttcagtaactccgagcagaaatcacatcttgcccacatgctgtaacctaagaaactgctatgcaaggctgggtgctgtggctcatgcctgtaatcccagcactttgggaggccaaggcaggtggatcacctgaggtcaggagttcgagacaagcgtggccaatatggcaaagcccagtctctactaataatacaaaaattagctgggcatggtggcgcatgcctgtaatcccagctactgggaaggctgaggtaggagaatcttttgaatctgggaagcggaggttgcagtgagctgagatcgcaccactgcactccagcctgggagatacagcgagactgtctccaaaaacaaaaacaaaaacaaaaaacattcaaacaactgtttgcaatataaaaagctcatttactgtaatatttatgatacagtgaatatgaaaatgcactggtcagaaggcactctcaaagagccgcactgctcctgacatcgtccttagcaatgaagtcacaaagacagccaaagcagtcctgcttcttggaaatcagaagctgcctttatcacatataaagccaaacagggcataaccatgtcacgtgagcatgtcatcaggcttctgaggacttgttctttataaaaaaagaccttcacaaaatatcttggcttagagatagcagtctttattaacaaaggccacctaggctgacacctgcagataatcatctccttttctttgtctatgttgtacattttcatgatataacttttaactatgtctagagaaggcaggctctgcaagagaggtgccctttcaacccgctcagtgccctggacaggagatgctgtgttaaactgttaatggatatctatatgagaagctcatttttgtatgctatccctgcagtttttttttttctaacaggcccatgtttgagaataaacaagtctgtgatgtcagagacaaaggtgtattcttcagtctgcaggtgtgtggcacctcccttctcccctgcagccccccacatccagagccgttcctgagagtgacatcatgcatcaagaaaacataaccttggtcctcaggtgaacccttggaacattctgtgaccgcctgatgtccattctgagccaccttggcacacatgcttacaggcagcactgctaagggttcaggtgccccatggctgacagcccgagttgcttctgtggaccatcatgccgctcggcacgtcctgagacagaagttgctgcaggaaggagcttctggagaggtcctgtggcatgtgtgggggtgtgtgtgtgtatgtttccttcttgaacagacattccaactttagatgtgtttatagaactgacctttttactaacaaaatacaatgatatatgttggaaactacttaatatgcttttcctgcacaccttagcaataactgtaggggtctctgctagagttgtttgtatgtacagcaattttgaacaaattgttttaaatgtaatataagagaattagtttaaggaagtaaagagaatcatttgcttgtgttacattttcagtgaggattcagtttaagagtcattcttaggacttccatttcctaatatttattcatgggtaatgaagaaatggtttgcattttgtggccagtcctaatttattttccagctgagccctaacttccggctcccacctacctccacggacttcctaacagagacttatgaataccaggatgtgtttttgttaagtcaggttcaattcgttgcccctgtcagttttatagagtgtgagggtcactccattaaagatctctcctgggtggatcctacttggatgttcaggtgattttgaaaactgctaacatttttaaaaggctagaacatcctttgacttcttgaaaatctgcatgtctggcttgggttttattaccacatgcctgagttcttcaagaatggaaggctcaagtattctcatcttccatttgccaaacttccttcctgatttgagtcacgtgttccacttggaaagaaagggaacagagagcctcctccatggacagtgtatgaatttcattgggaatcttgctctctcccgcctctatgcctttctctctttttaaccttactttacataatattatagatgggccaagaaaagaaaagatgacataacattttgatgaatttcacctattccattcttcacgtttcagaattggtcgactttgttagaagataattgaagtagccttgggtcaaaagcaaccttttcaattgtgatcatacctaaaacatataaaaaccctgccgtagattaaaagcaattataaaatcataaaattgaatgtttgcagaatcctggagcagtagatttctttgtctttggcctgcggactagaaagagggcagcagtagtatgctggagcttccctgggataccagccacatggtttcttttcattagatctgatttttgtttcccactgtagatctgattttgtagttgaaaacatttcaccaccatcaaacactatttctgaatattgtgcctttttatacctagcctagatgaaaaccgatgccattcttattcagaaaatccccccatcctacatgactgttatctagacataaagcaaagtgcatttaattcaaaatttggttcacaatataagtattttgtaaaagccagctgaaccagcattttatcaggtggaaatctctgcaagccaaattgctgatactccttcatgcagatcaacttggtgtcccagtcagaatagaacagcataattacctggagttagggggagtatttctgcactattacttgtcagggagagaagaaacttagaattgtccctcaaaggagtgtcaagaagtatgaataaatgtcctttcaccagctcacaggccagaaatggaggacccaagtcaactaggtgaaactactagcagacccagctttcccataataacctaatctgcaaattgttctattaaagtctcattgttttcaggatgcaatgaaagtggatttcaaaaggctttggaaaaataagtggaacatgactgatcttgaaaaaaaaagcaaaagcttaaatatttgatacaagtttacttagctacaacatactttacattgttgcctttagttatctcacaggcactgacattttatatttagaaaatacttttaatctttctaatctttttttgtaaatattagtgtccattctgtatgactcgctaacctactttgcaaggctttgggcaacattttagctcattaacttcaagatgatgtgtcatctgtataggtcaaagaatgggacttctgaactgaggaatttgctgttgacagccaaagtatagtgtacaagattgatgtaacttgatatgtatttttgttgaagttttttgtaaaaaaaaattatttacaatgttatttgaatgatttttttaaatgctgtgaatctatatttgttgttttgtatattaaaattcatttgccaaactc

SEQ ID NO: 29741 - DNA, 8457 bp, Homo sapiens
gtgtgctgccgcggcgcgggaggagagtgtgcgttgcgctttctcccgcgatcgccctgccggtcgctagctccgagggcgcgcactggatcccaggctcctccgagagtgcggcgacctcggggctccgccggcaccggaggtggctctgagggcagggacgtgttggacacgctgactttgtaggctccgccaagaggcgccgcaggagcccgtggccacccaggagcccgatgtgcaaggcaggtgtgagtgccaggacggcattcctggagatgaaggcctggagctgcggtctgcggactcggcagtgcccgtggccatgacccaggctgccgtgcggccctgggcaccctgcctggagaacatgaccactgccccaaacggcctcgggccaggccccgcagccccctgtgcaggctcggacctgaaagacgccaagatggtgacctcccttgcgtgtggaaatggagtctgtggctgcagccctggtggcgacacggacacccaggaagccaaactcagcccagccaagcttgtgcgcctcttttccaccagtcggaagaggacgggtgcccaccccgagcggccccactccatggtcctggtggggaactcctccacatggaacaccctcgcctccttccggaaaatgggatcctttaagaaactgaagtcctcagtcctgaaaggaattcagagccgagaggggtcaaatgcctgttcaaagggagaggcttcggagcatggcctgggaaagtccatcccaaatggcgctgtcccaggagcccaggcaagcaggggctcccccttagcaccgggaccagcatgtggtgccctcaggccagcagagtggggcacattggatggctccgacctcgaggacacggacgatgccttccagcggagcacacaccgctcccgcagcctccgcagagcctacggcctgggccgcatctgcctgctggatgcgccccagaaccatgcgacacccacgatagccactggccaggtgcccgccgtgtgtgagattctcgtgagggaccctgaaaacaacagcatgggctacaggaggagcaagagcacggacaatcttgcctttctgaagaagagctcctttaagcggaagtccacctccaatcttgcagacctcaggacggcccatgacgcacgggtaccacagaggaccctgagcagttcctccactgactcccaaaagcttgggtcaggaaggaccaaacgctggaggagcccgataagggccaaggactttgacagagtcttcaaacttgtgagcaatgtgactgaggctgcctggaggagggagagtcctaggagtggggccccatcccctggagaggccagcctgagacttcaggcacacagccggctgcatgacgactactcccgccgcgtctccaggagcactgagcaggacagcaggcggggcggggcggtcatgcatgggaccactgcaacctgcaccgtggcccccggtttcggctcagccacctctaaggggccccacctagacgctgacactgccgtatttcctcttgaaaccaaaagttcctgggcggtggaaagcgacagttcctgcacttgcagctctttgccaagcccgattgtccaggatgtgttgagcaaagactcctgtgacccaaacgctggcagccagttgacatttgaccctgagcagcctcccacccctctaaggcccaccacacccaagccccagagccctcagagcccccagagccccggggcaggaagtgccagctgtcacagcaatcacagtgccctgtccgcgaattcagaggaaagtgaaggaagggcagaagagcctgctcagagagagccagggcctgtgtccttgcaggatcccctggaagccacacatggtgatgagggcagcaaggaccttctggtgaacattggtgtggcagccggcccagaagaaaaggagaaggaggaggtcgtccctgatggcccctggaggcgaagctcatcacaggatgaggaaaggacagaggcacagagaacccccaagaggagatggggctctgggagacggccaaggcctcggccattctctgactacggccagctggccagccgcagtttgtctattcctgaagactcggttgctgcagacccccagaaggaagaccgtgtggacgaggacccccaggcaagcatgacttctgccagccctgaagaccagaatgctccagtgggctgccccaaaggagcccggagaaggcgccccatttccgtgataggtggggtcagcttgtatgggaccaaccagacggaggaactggacaatcttctgacccaaccggcttccaggccgcccatgcctgctcaccaggtgccaccctacaaggctgtgtcggcccggttccggcccttcacattctcccagagcacccccattgggttggaccgtgtgggacgccggcggcagatgagagcatccaacgtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagattgcgagtgaatcaggaagagctgtcggaaaactccagcagcacccccagtgaggagcaggacgaggaggccagccagagccgccacagacactgtgagaacaagcagcagatgcggaccaacgtcatccgggagatcatggacaccgagcgggtgtacatcaaacacctcagggacatctgtgagggctatatccgacagtgccgcaagcacacaggaatgttcaccgttgcgcagctagccactatttttggaaacattgaagatatttacaaattccaaagaaagtttctgaaagaccttgagaaacagtacaacaaagaggaacctcacttaagtgaaataggatcttgctttcttcaaaatcaagagggctttgccatctattccgagtactgcaacaaccacccgggcgcctgcctggagctcgccaacctcatgaagcagggcaagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtcaagacggggttgacacaatgctgcacgtgtctggtcacacttagaaattgagctcttactctcttctgtaatactgggggacctacagctgccgtggggctgaccacggtgttccctggcatcgtctgtgtccacacagatgctaactggtagtgcaaatgtcatcctgcaaggttcctcttcctgcaagcaaagtggagagaaagaagatgcatctgtcaccttcatcagggtcctcagtgcagagcaacttacgcatcctcaagaatccactgcttttcaggcaaggagggagaaatcctgctgcacactggctttgtcccggagtcggattccctcctgcctgcacgccttcagtaactccgagcagaaatcacatcttgcccacatgctgtaacctaagaaactgctatgcaaggctgggtgctgtggctcatgcctgtaatcccagcactttgggaggccaaggcaggtggatcacctgaggtcaggagttcgagacaagcgtggccaatatggcaaagcccagtctctactaataatacaaaaattagctgggcatggtggcgcatgcctgtaatcccagctactgggaaggctgaggtaggagaatcttttgaatctgggaagcggaggttgcagtgagctgagatcgcaccactgcactccagcctgggagatacagcgagactgtctccaaaaacaaaaacaaaaacaaaaaacattcaaacaactgtttgcaatataaaaagctcatttactgtaatatttatgatacagtgaatatgaaaatgcactggtcagaaggcactctcaaagagccgcactgctcctgacatcgtccttagcaatgaagtcacaaagacagccaaagcagtcctgcttcttggaaatcagaagctgcctttatcacatataaagccaaacagggcataaccatgtcacgtgagcatgtcatcaggcttctgaggacttgttctttataaaaaaagaccttcacaaaatatcttggcttagagatagcagtctttattaacaaaggccacctaggctgacacctgcagataatcatctccttttctttgtctatgttgtacattttcatgatataacttttaactatgtctagagaaggcaggctctgcaagagaggtgccctttcaacccgctcagtgccctggacaggagatgctgtgttaaactgttaatggatatctatatgagaagctcatttttgtatgctatccctgcagtttttttttttctaacaggcccatgtttgagaataaacaagtctgtgatgtcagagacaaaggtgtattcttcagtctgcaggtgtgtggcacctcccttctcccctgcagccccccacatccagagccgttcctgagagtgacatcatgcatcaagaaaacataaccttggtcctcaggtgaacccttggaacattctgtgaccgcctgatgtccattctgagccaccttggcacacatgcttacaggcagcactgctaagggttcaggtgccccatggctgacagcccgagttgcttctgtggaccatcatgccgctcggcacgtcctgagacagaagttgctgcaggaaggagcttctggagaggtcctgtggcatgtgtgggggtgtgtgtgtgtatgtttccttcttgaacagacattccaactttagatgtgtttatagaactgacctttttactaacaaaatacaatgatatatgttggaaactacttaatatgcttttcctgcacaccttagcaataactgtaggggtctctgctagagttgtttgtatgtacagcaattttgaacaaattgttttaaatgtaatataagagaattagtttaaggaagtaaagagaatcatttgcttgtgttacattttcagtgaggattcagtttaagagtcattcttaggacttccatttcctaatatttattcatgggtaatgaagaaatggtttgcattttgtggccagtcctaatttattttccagctgagccctaacttccggctcccacctacctccacggacttcctaacagagacttatgaataccaggatgtgtttttgttaagtcaggttcaattcgttgcccctgtcagttttatagagtgtgagggtcactccattaaagatctctcctgggtggatcctacttggatgttcaggtgattttgaaaactgctaacatttttaaaaggctagaacatcctttgacttcttgaaaatctgcatgtctggcttgggttttattaccacatgcctgagttcttcaagaatggaaggctcaagtattctcatcttccatttgccaaacttccttcctgatttgagtcacgtgttccacttggaaagaaagggaacagagagcctcctccatggacagtgtatgaatttcattgggaatcttgctctctcccgcctctatgcctttctctctttttaaccttactttacataatattatagatgggccaagaaaagaaaagatgacataacattttgatgaatttcacctattccattcttcacgtttcagaattggtcgactttgttagaagataattgaagtagccttgggtcaaaagcaaccttttcaattgtgatcatacctaaaacatataaaaaccctgccgtagattaaaagcaattataaaatcataaaattgaatgtttgcagaatcctggagcagtagatttctttgtctttggcctgcggactagaaagagggcagcagtagtatgctggagcttccctgggataccagccacatggtttcttttcattagatctgatttttgtttcccactgtagatctgattttgtagttgaaaacatttcaccaccatcaaacactatttctgaatattgtgcctttttatacctagcctagatgaaaaccgatgccattcttattcagaaaatccccccatcctacatgactgttatctagacataaagcaaagtgcatttaattcaaaatttggttcacaatataagtattttgtaaaagccagctgaaccagcattttatcaggtggaaatctctgcaagccaaattgctgatactccttcatgcagatcaacttggtgtcccagtcagaatagaacagcataattacctggagttagggggagtatttctgcactattacttgtcagggagagaagaaacttagaattgtccctcaaaggagtgtcaagaagtatgaataaatgtcctttcaccagctcacaggccagaaatggaggacccaagtcaactaggtgaaactactagcagacccagctttcccataataacctaatctgcaaattgttctattaaagtctcattgttttcaggatgcaatgaaagtggatttcaaaaggctttggaaaaataagtggaacatgactgatcttgaaaaaaaaagcaaaagcttaaatatttgatacaagtttacttagctacaacatactttacattgttgcctttagttatctcacaggcactgacattttatatttagaaaatacttttaatctttctaatctttttttgtaaatattagtgtccattctgtatgactcgctaacctactttgcaaggctttgggcaacattttagctcattaacttcaagatgatgtgtcatctgtataggtcaaagaatgggacttctgaactgaggaatttgctgttgacagccaaagtatagtgtacaagattgatgtaacttgatatgtatttttgttgaagttttttgtaaaaaaaaattatttacaatgttatttgaatgatttttttaaatgctgtgaatctatatttgttgttttgtatattaaaattcatttgccaaactcgt

SEQ ID NO: 29742 - DNA, 8242 bp, Homo sapiens
gcccgtggccacccaggagcccgatgtgcaaggcaggtgtgagtgccaggacggcattcctggagatgaaggcctggagctgcggtctgcggactcggcagtgcccgtggccatgacccaggctgccgtgcggccctgggcaccctgcctggagaacatgaccactgccccaaacggcctcgggccaggccccgcagccccctgtgcaggctcggacctgaaagacgccaagatggtgacctcccttgcgtgtggaaatggagtctgtggctgcagccctggtggcgacacggacacccaggaagccaaactcagcccagccaagcttgtgcgcctcttttccaccagtcggaagaggacgggtgcccaccccgagcggccccactccatggtcctggtggggaactcctccacatggaacaccctcgcctccttccggaaaatgggatcctttaagaaactgaagtcctcagtcctgaaaggaattcagagccgagaggggtcaaatgcctgttcaaagggagaggcttcggagcatggcctgggaaagtccatcccaaatggcgctgtcccaggagcccaggcaagcaggggctcccccttagcaccgggaccagcatgtggtgccctcaggccagcagagtggggcacattggatggctccgacctcgaggacacggacgatgccttccagcggagcacacaccgctcccgcagcctccgcagagcctacggcctgggccgcatctgcctgctggatgcgccccagaaccatgcgacacccacgatagccactggccaggtgcccgccgtgtgtgagattctcgtgagggaccctgaaaacaacagcatgggctacaggaggagcaagagcacggacaatcttgcctttctgaagaagagctcctttaagcggaagtccacctccaatcttgcagacctcaggacggcccatgacgcacgggtaccacagaggaccctgagcagttcctccactgactcccaaaagcttgggtcaggaaggaccaaacgctggaggagcccgataagggccaaggactttgacagagtcttcaaacttgtgagcaatgtgactgaggctgcctggaggagggagagtcctaggagtggggccccatcccctggagaggccagcctgagacttcaggcacacagccggctgcatgacgactactcccgccgcgtctccaggagcactgagcaggacagcaggcggggcggggcggtcatgcatgggaccactgcaacctgcaccgtggcccccggtttcggctcagccacctctaaggggccccacctagacgctgacactgccgtatttcctcttgaaaccaaaagttcctgggcggtggaaagcgacagttcctgcacttgcagctctttgccaagcccgattgtccaggatgtgttgagcaaagactcctgtgacccaaacgctggcagccagttgacatttgaccctgagcagcctcccacccctctaaggcccaccacacccaagccccagagccctcagagcccccagagccccggggcaggaagtgccagctgtcacagcaatcacagtgccctgtccgcgaattcagaggaaagtgaaggaagggcagaagagcctgctcagagagagccagggcctgtgtccttgcaggatcccctggaagccacacatggtgatgagggcagcaaggaccttctggtgaacattggtgtggcagccggcccagaagaaaaggagaaggaggaggtcgtccctgatggcccctggaggcgaagctcatcacaggatgaggaaaggacagaggcacagagaacccccaagaggagatggggctctgggagacggccaaggcctcggccattctctgactacggccagctggccagccgcagtttgtctattcctgaagactcggttgctgcagacccccagaaggaagaccgtgtggacgaggacccccaggcaagcatgacttctgccagccctgaagaccagaatgctccagtgggctgccccaaaggagcccggagaaggcgccccatttccgtgataggtggggtcagcttgtatgggaccaaccagacggaggaactggacaatcttctgacccaaccggcttccaggccgcccatgcctgctcaccaggtgccaccctacaaggctgtgtcggcccggttccggcccttcacattctcccagagcacccccattgggttggaccgtgtgggacgccggcggcagatgagagcatccaacgtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagattgcgagtgaatcaggaagagctgtcggaaaactccagcagcacccccagtgaggagcaggacgaggaggccagccagagccgccacagacactgtgagaacaagcagcagatgcggaccaacgtcatccgggagatcatggacaccgagcgggtgtacatcaaacacctcagggacatctgtgagggctatatccgacagtgccgcaagcacacaggaatgttcaccgttgcgcagctagccactatttttggaaacattgaagatatttacaaattccaaagaaagtttctgaaagaccttgagaaacagtacaacaaagaggaacctcacttaagtgaaataggatcttgctttcttcaaaatcaagagggctttgccatctattccgagtactgcaacaaccacccgggcgcctgcctggagctcgccaacctcatgaagcagggcaagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtcaagacggggttgacacaatgctgcacgtgtctggtcacacttagaaattgagctcttactctcttctgtaatactgggggacctacagctgccgtggggctgaccacggtgttccctggcatcgtctgtgtccacacagatgctaactggtagtgcaaatgtcatcctgcaaggttcctcttcctgcaagcaaagtggagagaaagaagatgcatctgtcaccttcatcagggtcctcagtgcagagcaacttacgcatcctcaagaatccactgcttttcaggcaaggagggagaaatcctgctgcacactggctttgtcccggagtcggattccctcctgcctgcacgccttcagtaactccgagcagaaatcacatcttgcccacatgctgtaacctaagaaactgctatgcaaggctgggtgctgtggctcatgcctgtaatcccagcactttgggaggccaaggcaggtggatcacctgaggtcaggagttcgagacaagcgtggccaatatggcaaagcccagtctctactaataatacaaaaattagctgggcatggtggcgcatgcctgtaatcccagctactgggaaggctgaggtaggagaatcttttgaatctgggaagcggaggttgcagtgagctgagatcgcaccactgcactccagcctgggagatacagcgagactgtctccaaaaacaaaaacaaaaacaaaaaacattcaaacaactgtttgcaatataaaaagctcatttactgtaatatttatgatacagtgaatatgaaaatgcactggtcagaaggcactctcaaagagccgcactgctcctgacatcgtccttagcaatgaagtcacaaagacagccaaagcagtcctgcttcttggaaatcagaagctgcctttatcacatataaagccaaacagggcataaccatgtcacgtgagcatgtcatcaggcttctgaggacttgttctttataaaaaaagaccttcacaaaatatcttggcttagagatagcagtctttattaacaaaggccacctaggctgacacctgcagataatcatctccttttctttgtctatgttgtacattttcatgatataacttttaactatgtctagagaaggcaggctctgcaagagaggtgccctttcaacccgctcagtgccctggacaggagatgctgtgttaaactgttaatggatatctatatgagaagctcatttttgtatgctatccctgcagtttttttttttctaacaggcccatgtttgagaataaacaagtctgtgatgtcagagacaaaggtgtattcttcagtctgcaggtgtgtggcacctcccttctcccctgcagccccccacatccagagccgttcctgagagtgacatcatgcatcaagaaaacataaccttggtcctcaggtgaacccttggaacattctgtgaccgcctgatgtccattctgagccaccttggcacacatgcttacaggcagcactgctaagggttcaggtgccccatggctgacagcccgagttgcttctgtggaccatcatgccgctcggcacgtcctgagacagaagttgctgcaggaaggagcttctggagaggtcctgtggcatgtgtgggggtgtgtgtgtgtatgtttccttcttgaacagacattccaactttagatgtgtttatagaactgacctttttactaacaaaatacaatgatatatgttggaaactacttaatatgcttttcctgcacaccttagcaataactgtaggggtctctgctagagttgtttgtatgtacagcaattttgaacaaattgttttaaatgtaatataagagaattagtttaaggaagtaaagagaatcatttgcttgtgttacattttcagtgaggattcagtttaagagtcattcttaggacttccatttcctaatatttattcatgggtaatgaagaaatggtttgcattttgtggccagtcctaatttattttccagctgagccctaacttccggctcccacctacctccacggacttcctaacagagacttatgaataccaggatgtgtttttgttaagtcaggttcaattcgttgcccctgtcagttttatagagtgtgagggtcactccattaaagatctctcctgggtggatcctacttggatgttcaggtgattttgaaaactgctaacatttttaaaaggctagaacatcctttgacttcttgaaaatctgcatgtctggcttgggttttattaccacatgcctgagttcttcaagaatggaaggctcaagtattctcatcttccatttgccaaacttccttcctgatttgagtcacgtgttccacttggaaagaaagggaacagagagcctcctccatggacagtgtatgaatttcattgggaatcttgctctctcccgcctctatgcctttctctctttttaaccttactttacataatattatagatgggccaagaaaagaaaagatgacataacattttgatgaatttcacctattccattcttcacgtttcagaattggtcgactttgttagaagataattgaagtagccttgggtcaaaagcaaccttttcaattgtgatcatacctaaaacatataaaaaccctgccgtagattaaaagcaattataaaatcataaaattgaatgtttgcagaatcctggagcagtagatttctttgtctttggcctgcggactagaaagagggcagcagtagtatgctggagcttccctgggataccagccacatggtttcttttcattagatctgatttttgtttcccactgtagatctgattttgtagttgaaaacatttcaccaccatcaaacactatttctgaatattgtgcctttttatacctagcctagatgaaaaccgatgccattcttattcagaaaatccccccatcctacatgactgttatctagacataaagcaaagtgcatttaattcaaaatttggttcacaatataagtattttgtaaaagccagctgaaccagcattttatcaggtggaaatctctgcaagccaaattgctgatactccttcatgcagatcaacttggtgtcccagtcagaatagaacagcataattacctggagttagggggagtatttctgcactattacttgtcagggagagaagaaacttagaattgtccctcaaaggagtgtcaagaagtatgaataaatgtcctttcaccagctcacaggccagaaatggaggacccaagtcaactaggtgaaactactagcagacccagctttcccataataacctaatctgcaaattgttctattaaagtctcattgttttcaggatgcaatgaaagtggatttcaaaaggctttggaaaaataagtggaacatgactgatcttgaaaaaaaaagcaaaagcttaaatatttgatacaagtttacttagctacaacatactttacattgttgcctttagttatctcacaggcactgacattttatatttagaaaatacttttaatctttctaatctttttttgtaaatattagtgtccattctgtatgactcgctaacctactttgcaaggctttgggcaacattttagctcattaacttcaagatgatgtgtcatctgtataggtcaaagaatgggacttctgaactgaggaatttgctgttgacagccaaagtatagtgtacaagattgatgtaacttgatatgtatttttgttgaagttttttgtaaaaaaaaattatttacaatgttatttgaatgatttttttaaatgctgtgaatctatatttgttgttttgtatattaaaattcatttgccaaa

SEQ ID NO: 29743 - DNA, 2111 bp, Homo sapiens
acagattttgctttctttttgcagccggcttccaggccgcccatgcctgctcaccaggtgccaccctacaaggctgtgtcggcccggttccggcccttcacattctcccagagcacccccattgggttggaccgtgtgggacgccggcggcagatgagagcatccaacgtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagattgcgagtgaatcaggaagagctgtcggaaaactccagcagcacccccagtgaggagcaggacgaggaggccagccagagccgccacagacactgtgagaacaagcagcagatgcggaccaacgtcatccgggagatcatggacaccgagcgggtgtacatcaaacacctcagggacatctgtgagggctatatccgacagtgccgcaagcacacaggaatgttcaccgttgcgcagctagccactatttttggaaacattgaagatatttacaaattccaaagaaagtttctgaaagaccttgagaaacagtacaacaaagaggaacctcacttaagtgaaataggatcttgctttcttcaaaatcaagagggctttgccatctattccgagtactgcaacaaccacccgggcgcctgcctggagctcgccaacctcatgaagcagggcaagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaagtcaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaaattgagctcttactctcttctgtaatactgggggacctacagctgccgtggggctgaccacggtgttccctggcatcgtctgtgtccacacagatgctaactggtagtgcaaatgtcatcctgcaaggttcctcttcctgcaagcaaagtggagagaaagaagatgcatctgtcaccttcatcagggtcctcagtgcagagcaacttacgcatcctcaagaat

SEQ ID NO: 29744 - DNA, 2106 bp, Homo sapiens
atgggcctcgtggcacgggacgtttcaagtcctggcgtccccgcgagcaagcagcctgatcaggcctcgcagtgggacgttgggaagccggtgttggcagatgctgtggctgggaggagtccagagcttcgccctgtccccgcggggctgagccacaactgcttaggagttttgggcaggatcgatggatgcaggaagcagtaggagtttggagaatgcagtgaataggatctatcatgatcagcttgttccaaagataaacacaagcaagaaaatgtccaccttagcgcacccacctaacatcctggaaatgtcacaagagattaagaaaaactgtggaggtaaacaggtagaaatcacacttgaaagaacaaaaatgacaaagggcatcaaagaaaaacaaagcaatgatttagagaaagcagcctttaaacggaaggcagaaggtgaagaaaagccaactagaaagaaacaggcaaagataacagaacttgacaatcagttaatcaccatgcctctgcctcacatccccttaaagaacataatggatgtggaaatgaagttggtctacattgatgaaatgggtgttcgctatgagtttgtagagtccttcatgtctactgggagtcagccaacatgccaagctgctgaaatagtagaccctttgagtgtacataatttcagctttctgcctcagattgacaaatggcttcaggtagccttaaaggatgccagctcttgctatagacaaaagaaatacgccttggcagcaggacagttcagaacagcacttgagctttgcagcaaaggagcagttctgggagaaccatttgatgcacctgctgaagatatagcaagcgtggcaagtttcattgagacaaagcttgttacctgttatctacggatgaggaaaccagatcttgccctgaatcatgcacacaggagcattgttttaaacccagcctatttccggaatcatcttcgtcaagcaacagtgtttagatgtctggagaggtattcagaggctgcccggagtgccatgattgctgactacatgttctggcttggtggaggaagggaagagagcataagcaagctcatcaaactgtattggcaggccatgattgaggaagccatcaccagagctgaatctttctcggttatgtacacaccatttgcgacaaaaataagagctgataaaatagaaaaagtaaaagatgctttcacaaaaactcatcctgcatatgcagagtatatgtacacagatcttcaagcactccacatgttgcctcagacagttgactggtcatcttttcctccccaacaatatctcttgactcttgggttcaaaaacaaagatgatggaaaatttttggaaaaaatatcaagcaggaagctgccgatattcacagagcataaaacacctttcggtctgaccagagaagatacagtgaggcaaatggagacaatggggaagcgaatcttgccaatattggattttattagaagcacccaattgaatgggagttttcctgcatcctcaggtgtgatggagaagttgcaatatgccagcctcctcagccagctgcagagagtaaaggagcagtcccaggtgattaatcaagcaatggcagagctagcaaccattccctacctacaggacatcagtcaacaggaggcagaattgctgcagtcactaatggcagatgctatggacacccttgaaggaagaagaaacaataatgaacgtgtgtggaatatgatccaaaaggttggacaaattgaagattttctataccaattagaggacagtttcttaaaaactaaaaaactgagaactgctcgaaggcaaaaaacaaaaatgaagcgacttcaaactgttcagcaaaggtagtcattagggagcaggcactaccactaagatatcccagaagaagaggcaagggcatccactccaatgcccacctagtactgtgaagctggataacaaaagcttgtcaccaaaagaaagaggtggtattcccctcagttcatctttaccaaagacactctatgtttcattaatctcaactggcagcaataaatattctcagcaagtttgacttg

SEQ ID NO: 29745 - DNA, 5818 bp, Homo sapiens
cagttaccatggagaccggtagtaacaccagttgtaaacccaaggccaagagaccatggccacgttagcccggctgcaagctaggtcgtcgactgtaggaaatcagtactactttaggaacagtgttgtagatccatttagaaaaaaggagaatgatgcagcagttaaaatccaaagctggtttcgaggatgtcaagttcgggcatatatcaggcatttaaacaggattgtaacaattattcaaaaatggtggagaagtttcttaggcagaaagcaatatcaactaactgtgcaggtagcatattatactatgatgatgaatctctacaatgcaatggctgtcaggattcagagacgatggcgaggctatagggttcggaagtacctctttaattattattatttgaaagagtacctgaaagtcgtttcagagaccaatgatgcaattaggaaggcactggaggagtttgcagaaatgaaagaaagagaagagaagaaggctaacctcgaaagggaagagaagaaaagagattaccaagcccgaaagatgcattacctcctcagcacaaagcagattccaggaatatacaattcacccttcagaaaagagcctgatccatgggagctgcaattacagaaggcaaagcctttaacacaccgaagacctaaagttaagcagaaggactccaccagccttactgattggctagcttgtacaagcgcccgttcttttcctcggtctgaaattctaccacctattaatagaaagcaatgtcaggggcccttccgagatatcaccgaagtattagaacaacgctacaggcctttggagccaacgttgcgggtggcagaaccaatcgatgagttaaagttggccagagaggagctcagaagagaggaatggctgcaaaatgtaaatgacaatatgtttttgccattttcttcataccataaaaatgaaaagtacatcccatcaatgcatttatcaagcaagtatggtcctatttcttacaaagaacaattccgaagtgaaaatcctaagaaatggatctgtgacaaggatttccagactgtattaccatcatttgagctcttctcaaagtatggaaaattatattcaaaagctggacagattgtataaaggcgtcagaagaagaaactgaagccatctgcattttaaaacttaacagttctgaaaggaaaacacagatgaagatcctgtaggaaatatacttgctatgattcaataaactataaaattttgtagctctagtcatgaattaattattgtgtgtatgtatttgaaatctcttagacatatcttttcaaacaaatacttaaacttgagtctgttacctctgagaatgtctgtcacaatcacagcccctggtgaccaacagtgccataaatggttcccctgaaatacccatattctgaccccatcacccgggtcacaaatgatgacaccagtgctgggtacccaaattaagggcgactaacatgtaagtaggatgatgaatggtttgaagtgtaaattgtgtgaaatagttcagcatgaaagctctgccctgagaaataatgactgattataccagttagaaacccttcagactgttgaacttgagacacacagacacaacagacacagactagtgggtgtgggagcagaagcataggcactctcaaatagagaagacatttgcaagtctctgctgccaagggagcaaagagataatctcgatgccagggctgtgtcagatcctgcatggctctgaactacagttggtttccaaaaagctgggcttttgtgaggtttctgttttttatgcgatgcttagattttcctggaatccttggaagttaactcaacatttgaggttcctatatcctttaatcccatcccatgtgtatctttacaataaaacttcctgctagaggtatcctgagggaatctttgtttcttgcatctgaagagaataacactaaacttattgcatatgatttgggggttggatccaatgatagcacagagggacaggaaatgtgatttattgaccataaaagctttaatttaaaattgctggccagcgaaatccagactctgggaaatgttataggccaaatgatctgtttcttcaacaaataaattacaaaactgaggggaaaaaaaggaacctattaaaaagacattatctatcaatcactgtgtgtgtacagttttgagctcctgatttaaataaacaaattgtaaaataaaagatcttttgaaacaattggaagtttgaacactgattggatattggtggtataaaagaattattggttttttttaggtgtcatggtattgttttggtttacaaagttatagatataaatgttgaaatatttacagatgcagtgatatgttggctgggatttaatttgaaagtcaaagaagtgagttaaaatacatatactcctcctcttataatcggttatgtgccaataaatccattgtaaattgaaaatatcctaagttgaaaatattgtaagttaaaaatgcatttaatacagctaacttaccagacagcttagcttagcctcacctaccttaaatatgctcagaacacatacgttagcctatagttgggcaaaatcatctaacacaaagcctattttataatattgaacagcccatgtaatttattgaatattgtactaaaagtgaaaaactgaatagttgtatgcatactcaaagtatggtttctactgaatgcattgtaaaccagaaagtatctgagacaatgttttttttttttttttttttttttttaatttctgagacagagtctcattctgtcacccaggttggagtgcagtggcatgaactcagctcactgcaaccttcacctcccaggctcaagcagtcctcccatctcagcctcccaagtagctgggaccacaggcatgggccaacaagcctggctaaatattttgtacttttggtagacacgggtttttaccatgttgtgcaggctggtcttgaacgcctgagctcaagtgatctgcctgcctcggcctcccaaagtactgggattacaggcatgagtcactgaacccagccctgagacatgtctcaattagtttagaagtttatttggccaaggttaaggacatgcccttgacactgcacctgtcagtacaggtcctgacaacatgtgtccaaggtggtcaagctatacaacttggttttatacattttaaggagacataagacatcaataaatacatggaagatgtacattggttcagtctggaaaggcaggatgcctcaaacttgaaacaagagaatggggggtgggaggatgtgggagatgcttccaggtcatagttggagtcaaagactttccaattggcaattggttcaaagaatttatctaaagacctggaatccatagaaggctttacctggattaaaataaggggaccaaggttctcatgcagatgaagcctccaggtggcagacttcagagagcatagattgtaaatgtttcttatctgacttaaaaaggtgtcagactcttagtaaattatctcctggatcagtgaaaagatgtgaaaaaaggttctctacagaatgtagattttccccataagagatagcttcgcagggccattgcaaaatatgtcaaaaatatatattttagggtaaaatgcctcaatttatttcaaggcctgatatttgtcatgtgatgctatactacagtcaggctgaaacttggcatcttattgctatgaaaaatcttaagatctctattttaatgttaatgctggtcactggtgcctgaattccaaagggaggagggtataatgaagcatgtccaattccccatgccccacccccacccccacatcctataatggcctgaactagtttttcaggttaactttggaatacccttggccaagaagaggggtccatgcagatgtttggaggggggggtcttaaagctttatttttagattacagcatattgcttttgcactatcataaagtaaaaacatcataagtcaagccaccataaatagcggaccatctgtatatctgaaagaagatgaaccaagacttggttattgttaaagctgatgattggctgtatgaagatttactatacaattttgtgtacttttgtaagttcttggttgtttctaaacttataacaaaataaataattggccatcttcattggattgtgaagccatttcctcccacatgttcgtaaaaatggtagccatggcccctgactgaacccaggtatgaatggccttcattgattttgtagaccctgaccttctctgttcttccagagaaggtggtactcagataaaaactttgaagcattttattgttcagaatatgactttgatcttctcataagactcaagtttttgaatgcttaaggctctttatcgctagtgtatgtaagtaatatcattgtccttaaccaccatctgcctctccccccagacacacataagtttatgataactacagaggtgtccagatgagtaaaaactgcctttgcattaaggtgagagaagaccgagatgaaatcttattagaaaatataactggggaaagcagtttgtctgtttctcctggaaaactactagactacatcaacttatatactacttcttttctatattctcaatatgagccacttaagaaaattaatgagactttatgtttgaccaaagctggtaattccttgatcttattctccaaacttgattctgaatgactactgaccactaaaaacactaagagtaccactgtggatgtttaaaaacatacaccctaagagccttcagaattagacgcttcaattcttctgaaatcaaaagtcacaccagctttgctgtagttaatcaggtaatacctttcttctccactactctctaatttccttgagggcaaatattgtctttcttgataaatgccctggacccaacatctaacagaatacctggcataaagtgaaatccatcgaatgtgctaatgataaataaagaagttcaaaaaaatcttttaatagaagctataaaatagcagataagctaagtcattctcataaaacaccatttgtcatttgaatgcgtgcattgtggcctgttacttttaactagtctcactaatttatagttatatatgatgtagatctagattgtgatgtacactaagtgggttgatcctgagatcaagctatgattgctgcttgcgtaaagtgttccttttgggaaataaataatctttcatatctgtaaactttggtataattggttatttatgcaatgtattgttgtggttgtcaactcaagattgtattctcatctggggacattatgaatcttgttattttatccccttttttgctctgttttttcacatttatggcctacctgttacagctgcacggtatccattttctgtgctaaattcatctttaatttattattttttttcaacctcagcttttaactttgccctgattttctcttccattttattttcacttccattttaagctggctcaaagccttttaggaacaataagttactgaattatatgaacctatttgaggtaatgatgatgcctgggaaggagcagtattgctggatcagaattcactttttccaagttacagattttaataaaccactgtgcaaagcattaggataaatttttattgaaaattgagtgaatgactgaacaaatcgctgggtaatgctgtttaggttgttctattttccacggattaaattaaattctatgta

SEQ ID NO: 29746 - DNA, 4396 bp, Homo sapiens
acccagggcggggcggcgcgggcgttgccacgacgcgggccgcgcgcgtccctggcagccaacccgtccacgtcaaggtttgtttaataatcgccagggtatctatggccgggctcaggcggctgctggggagccaggagaccgcgcgggacggcggatgaggcgcggcggctgcggcccagggcacctcccctctggcttcccgaacccggccaggtccgacccgagggggaggatggaaacacctgccgcgctctgagccccccagaagagaacacccttcccgccatatcaccccacggtcctgcggaggccaccgcctggtccccccaagtctccatcgcgcagcgtggggccgagaggaatagtgagcgatggcggaaaacctgaaaagactggtctcaaacgaaactttacgaacgttgcaggaaaagctagacttctggctgaaggagtacaacacaaacacgtgtgatcaaaatctaaaccattgccttgaactcattgagcaagttgccaaggtgcagggacaactctttgggatcctcacagcagcagcccaagaaggaggacgtaatgatggtgtggaaacaatcaagtcacgccttttgccttggctggaggcttcctttactgctgcttccctgggaaaatctgttgacagcaaggtcccctctctgcaggacacgtttgatagggagagacataaagatcccagtcctcgggatcgggatatgcaacagttagactctaatttgaactcaacccggagtcaatgcaaccaggttcaagacgatctggttgaaactgaaaagaatcttgaagaaagcaagaacagatcggccatatcccttttggctgcagaggaggaaataaatcagctgaaaaagcagcttaaatctcttcaagctcaggaggatgcccgccacagaaacacagatcagaggagctcagagaataggcggtcagagccttggagcttggaggagcggaagcgtgagcagtggaactcactcaagcagaatgcagaccagcaggacacagaagccatgtccgattataagaaacagctccgaaacctgaaggaggagatagctgttctgtctgctgagaaaagtgcactccaaggaaggtcctccaggagccggtctcccagccctgcccctcgcagccgtagctgcagccgcagcagatctgccagcccctccaccgctgtcaaggtcaggagaccgtccccaaaccgctccaagctgtccaatgtggcgcgcaaggctgccctcttgtcccggttcagcgattcctattcccaggcccgcctggacgcgcagtgcctgctgcggcgctgcatcgacaaggctgagaccgttcagcggatcatctacatcgccacagtggaggcattccatgtagcaaaaatggcattcagacacttcaagatccatgtgagaaaatcgttgacaccatcttatgtggggtcgaatgactttgagaatgctgtcttggattatgtcatttgtcatcttgatctatatgattctcaaagcagtgtcaatgatgtgatccgagccatgaatgtcaatcccaagatttcattccctcctgtcgttgacttttgccttctcagtgacttcatccaggagatatgttgcattgcctttgcaatgcaggccttagaaccacccctagatattgcatatggagcagatggagaagtttttaatgattgcaaataccgccgcagctacgactcggatttcactgctcccttagtcctctatcacgtgtggcctgctctcatggagaatgactgtgtcattatgaagggagaagctgtcaccaggagaggggctttttggaattcggtgcgatctgtaagtcgttgtcgaagcaggagtttaagtcccatttgcccccgtagccaaattggtttaaacacgatgtctcgaagtcggagtccttctccaataagatgtggattgccaagattttaaaagcaccagacctgctcctttgacccagtgcgtggaaacagctgctttctccagtgccgccatctgtcttctgtgtctgcctcagacctcacttaagataatgtcaaaaggcaattctgtgtatcaccccacacagagagttaaatgttttggcttggcgcatttgtaactttagatatattgcattctattttattttatagatactaattccattaatttcataaaaatgattgtataggcatttaggatcatattcattcgaagcaaagtccgttacaaaggttcaagatttccatctcaaaacactacgctcttttatgggaactgtgtgaactgaagtggaaagcatctaccatgctgaggctaaaagaaaagatgaatcattttagtttgcagatggatcgtaaatataattgttggtatcagctttagctcaaaaccaatattaggtgttttaatttccttttaaggtttggaagacagccctaatctcaggttggggagctcatgttagtagcagtgacttaaggctaagtgtagaagataatttaagatacattttctttatatattagccaacaaattatatttattggttggcttgcttttccgttctgattttgagagtgcccagtttggtttagttgaccaatgaatgtcaaagctacttagttgagagaatttccttgttcataaatgtagagcagtgatttgattagaagccagctttgagataaatgttaattacctcatgcatatctcctgggaatatttcaaactgttttaatgcatgtgttatatataaaagtttcttgggacatgctcttcacctgttctacctagttatttgcaaattcagacctcctattgaactctgtctgaccaaaactacttaaactcaaggcccaaaactaggggcaccatttactgattttaaattgagtatatatcccttgacttcttcactgtcaaatacttttgaaacttcacgttcaagataagaatggaatgttgctttcttgcaataagtaatgttctttctgcctttttttcacttttaagtcagccttaaacacatgcctcacaaacatctactttctccacatacctttgagagagacactgaattggcctcagctcagttttgcataagcttagtgccagaaccagcacctgatgcttttcaggtgaaaataaaacaaacagcttctctaaagcatcttacccctgtgctggaggtttgagggacctcttcagtgcctgccccttgagtctaatggtcaccacctcattctgaagtatgagttgaattttttgccctctttgcatatttacattagtcatcactttgaagcaatgcagtgtgctggaaggagcactatctgcctaggtaactgctagtcatgacttggtcatcagcttgctttgtggcactgagcaagttacttcacttctctgagccttggttttatcatagggtgaggaggttggatacaattagtgcccctcttaaccctgcagactcaatgttcccttttataacaagtattttattctgaatatgaaatgaaaattaaagttaatataatcatctatgtgcatgtataattttaagcagtgaacatagtaccctaactataatataaagcagaaaaaaaggcaacttttaataaaataaaatgtatttcaataaaaaagcttgggtataaccaccctagaagataaaattaagtcattagatggctgaacctgcatgtagagccaccagctacaaatgaaaatcaatgtgtgtattggcaacagaaaatcacggtgttgtcattggatgtgactttctgaagtggtgggcaattcttgttaatgttttaaacaaaaaaaaaaaaaccttacagtcttgccctgatttacacagcagtcacattcctggaaaattcaagtgtttattaaaactatgcaacagttactgtgtgttatacgttgaaaggtcttcactaatatctcactaagtaatgagaatgcctacatatcagaattttttttttcaggagccaagcacatatactgatttggaaaaaggcacaggtagctcagtttatttgctttctaccctgcctggccacttgctgtttcttcagtttctaatttgagctgtaactacacaaggaaagctaaatagtctggaaaatttttggaaagaatccacaaagccaaaggagactggcctatactcattttatctggggatgtaccttacccttagagactttgaaaaatgtgaagctcttattttgtaacctgggtaaatgttagtttctagattttcggcttaacatctaataataacatttaaaaagtgcttttgtaactattagttatttgcaataaaatgctttccttctaca

SEQ ID NO: 29747 - DNA, 861 bp, Homo sapiens
aggcagcttcaatggaaggagggagccaagaagggggcctggtatacattcaaagatgataattacgacatggattgtgtatattcttgctcggaaaggtgtagggcttcccttcctaccaataaccagttcggacattgacgttgtggaaagtgaggctgtgtctgtactacatcattggttgaaaaaaacagaagaagaggcttctcggggcataaaggaaaagctgtccatcaaccacccttcccagggtgtaagggagaagatgtccactgactcccctcccacccatggccaggacatccacgtgaccagagatgtggtgaagcaccacctctctaagtctgatttgttggcaaaccagagccaagaggtcctagaggagagaacacgaatccagttcataagatggagccacactcgtatcttccaagtgccaagtgagatgacagaggacatcatgcgagatcgaatagagcaggtgagacgaagcatatcccgtcttacagatgtctcagctcaggacttcagtatgagaccctcctcctcagactgctgagagcaacagatggagctttgggaacgcggagaacagtggggttacagggagtcatcatcagccctaccccttggccaaccacatctccctgctgtgtcccctgggcatttctctacctcccaggtggaagtccttcagggtccagcagcaacctgtatcagaagaacatccttctctgcttgacctgaagaagggccagacctgggcagaaagactccagcaggtgagctcttcatgcgacagtgtcagcactggagtcttcttgctgaactgcgaataaagagatgtgctgtttaacaacc

SEQ ID NO: 29748 - DNA, 653 bp, Homo sapiens
ctcccttcaatgaccttcctgtcccataggagttctcaggcagcttcaatggaaggagggagccaagaagggggcctggtatacattcaaagatgataattacgacatggattgtgtatattcttgctcggaaaggtgtagggcttcccttcctaccaataaccagttcggacattgacgttgtggaaagtgaggctgtgtctgtactacatcattggttgaaaaaaacagaagaagaggcttctcggggcataaaggaaaagctgtccatcaaccacccttcccagggtgtaagggagaagatgtccactgactcccctcccacccatggccaggacatccacgtgaccagagatgtggtgaagcaccacctctctaagtctgatttgttggcaaaccagagccaagaggtcctagaggagagaacacgaatccagttcataagatggagccacactcgtatcttccaagtgccaagtgagatgacagaggacatcatgcgagatcgaatagagcaggtgagacgaagcatatcccgtcttacagatgtctcagctcaggacttcagtatgagaccctcctcctcagactgctgagagcaacaggtggaagtccttcagggtccagcagcaacctgtatcagaagaacatcc

SEQ ID NO: 29749 - DNA, 4022 bp, Homo sapiens
cccgggtactggtctcagtacccctgcagccggccggagaggctagagcccgacggggcccggctccggcggcagccgcgcctctcgcttgcttccctcggccgggccgtcctcggcggcagtgtcaggagcactccgctggtccaggcggcaacatgtccatgcttttagtgatgtccctgcctctaatccagaagccatggaggagataaggtagcccccctcgatcggatggggaagcccagttcaatggatactaaattcaaggatgacttatttcggaagtacgtgcagttccatgagagcaaagtggataccaccaccagcaggcagcggcctggcagcgatgagtgcctgcgggtggcagcctcaaccctgctcagcctgcacaaggtggatcccttttatcgattccggctgatccagttctatgaggtggtggagagctccttgcgctcgctcagctcctctagcctgcgggctctgcacggcgccttcagcatgctggagacggtgggcatcaacctcttcctctacccgtggaagaaggaattcagaagcatcaagacctacacgggcccttttgtttattatgtcaagtcgacattactggaagaggacatccgagccatcctgagctgcatgggctacacacctgagctgggcactgcatacaagctcagagagctcgtggagaccctccaggtgaagatggtctcctttgagctctttctggccaaagtcgagtgtgagcagatgctagaaatccactcacaagtgaaggacaagggctactccgagctggacattgtgagcgagcgcaagagcagtgcagaggatgtgcgcggctgctcggacgccctgcggcggcgggcagagggccgggagcacctgacggcctccatgtcacgagtggcactccagaagtcggccagcgagcgggcggccaaggactactacaagccccgcgtgaccaagccctcgaggtcagtggatgcctatgacagctactgggagagccggaagccacccctgaaggcctcattgagtcttcggaaggagcctgtggcaacggatgtgggggacgacctcaaggatgagatcatccgcccatccccttcgctgctgaccatggccagctccccccacggcagcccggatgtgcttccacccgcctcccccagcaacggcccggccctgctgcgcggtacctacttctccactcaggatgacgtggatctgtacacagactctgaacccagggccacctaccgtcggcaggatgctctgcggccggatgtgtggctgctcagaaacgatgcccactccctctaccacaagcgctcgccccctgccaaagagtccgccctctccaagtgccaaagctgcgggctgtcctgcagctcctccctctgccagcgctgtgacagcctgctcacctgtcctccagcttccaagcccagcgccttccccagcaaggcctcgactcatgacagcctggcccacggggcatctctgcgggagaagtacccaggccagactcagggcctcgaccgcctcccgcaccttcactccaaatccaagccctccaccacgcccacttcccgctgtggcttctgcaaccgcccaggcgccaccaacacctgcacccagtgttcaaaagtctcatgtgacgcctgcctcagcgcttaccattatgacccctgctacaaaaagagtgagctgcacaagttcatgcccaacaaccagctgaactacaagtccacccagctctcccatctcgtgtacagatagaccggcctcgccccttccagctccaagggctacatcaaccgacctttcgggtttcacggtgaagaagtactaacgcattgatctcagaggcggaggcctgcacttgaccatgtaggtggcagagatcgtgggctggctgtgtccacgtgggagttcacttagcgactcagatatctcaaccaatggctgctttgttgtctgacaagggagaaggtggcacttccgttcagattcattttgctaatctctccactccctgttcagttggttctttttttggggttttgttttgttttgttttgttgttttgttttttcctttaaagaggatttctgtctctgggaccctcgctgcacctacccctcccattgcaaagccaacttggactgggaagggcccttcaggtcaccaaacatccacctggagcggcgagctagaggcctgttggcttgtgaaatgagccctcctgccacacggggcctctcccaaaggctcatcccttggccgcccccttcctaaacacaaggatccccagctggactccccaccccctggcttccccacctctccaggtgtcaaaggtgaaccgagtccagtattagctgaatgtcatttcgtacaccacagctcagtcagcccatggccttcgtgaactttgctccaacacactgatgtgtgggcttcccacagcaggactgacttccccctttctgttgtttgcacatgcccctcttactgtactgtcaatagatatttttgagatttatttttaaataaatattcaacttgctgtgtgtttcaacgtggttaaaaaaatgaattatgtagctatttattaaatgccctgggttctttagtcttccaagggagggcctcgcgcccattcgtgttgtatcctccactcactatggcccgaggggagaggagagtttggggcagggaggaacagacatgaagcctccttttcttgagctggtggagagccactgtcttccctgcagtaactatctatacacctacctccagtgtgcacttagggggtgagcgcgggtgtcgaggtctgtgtgtctgcagactgctaacctatgacaattcagggacctcacctgtcggacctatagcttgctgagcaggaaccttgcacttcacacttcttgagtctcgtttcagaaggaaaatcatttgggattcctactgcccctccatctcaatcctcttctcttcaccagtttccaggactcatctgcaacatttgcaatctttttgcactaaaagtgggcaggagtcggcatgtgcccatcagagagacggctcctcagatgctcagctaagcctaagcgcttccaagcctgaaggccccttcagcttctcatgtgaattaccaacccctggattttccttgtgggggtacaagagcaggagtggggcaagagtttgaaaataaagccgcttccttgtgaactaactatattttagccataactgtttgtgatgtacacaatgttaagggatttatatgcagtgggcttttctgggagaaagttattcagctcttgagcaagtttaagtctggctgaatcctgaggccactgtgaatttgctgatgttcttccaactcagttgagtgattttaaggttttccaaatcttctatggctctctttttaatatatatatatatatatatatatatatatatatatatatatatatatatctatctggtagatcacatgtagatgtacagtgtgtatattaagctgaatttcaaccaactttattactaagaccagcctagcagggcattcatctttgatgttcttccttttcacatttcagaatcggcaatgcctggcccactcctgagagctctagttttctagttttccatttccagattgcgccagcattacagtaactaactctttctaaccaaccgtgatgccacgtaacttaccctatggacaaaagcaggaatgactaacacatcctaggagggaaagtccagtgtacctgtcatcacggacgcactgtggtcacagactggaatacgaaatactacagccctgctcccaggtgtgcatcttactggatgaggttgctgtgattgagatagttaaatacatgctaatttaaaaatgcagatgttttacatttgatttctaccaagagttgaaatgttgagagatgattaaaaataataataataaagtgtcttccattgttaaa

SEQ ID NO: 29750 - DNA, 4138 bp, Homo sapiens
gagcttacatcatatagagattagctctcctagccccattcggtgtgggaagatgggaattttgctactacaggaatttttgtaactcaactctgctcgcgccgccataaggcattctaacttagccaaacactttcgagtagagctgtccagcagatgcagcaggatggctttgcaagagtcggagttttggcgttagacctaggttcagagctcagatccacttcttcctagccttacgacttaggagcactccgctggtccaggcggcaacatgtccatgcttttagtgatgtccctgcctctaatccagaagccatggaggagataaggtagcccccctcgatcggatggggaagcccagttcaatggatactaaattcaaggatgacttatttcggaagtacgtgcagttccatgagagcaaagtggataccaccaccagcaggcagcggcctggcagcgatgagtgcctgcgggtggcagcctcaaccctgctcagcctgcacaaggtggatcccttttatcgattccggctgatccagttctatgaggtggtggagagctccttgcgctcgctcagctcctctagcctgcgggctctgcacggcgccttcagcatgctggagacggtgggcatcaacctcttcctctacccgtggaagaaggaattcagaagcatcaagacctacacgggcccttttgtttattatgtcaagtcgacattactggaagaggacatccgagccatcctgagctgcatgggctacacacctgagctgggcactgcatacaagctcagagagctcgtggagaccctccaggtgaagatggtctcctttgagctctttctggccaaagtcgagtgtgagcagatgctagaaatccactcacaagtgaaggacaagggctactccgagctggacattgtgagcgagcgcaagagcagtgcagaggatgtgcgcggctgctcggacgccctgcggcggcgggcagagggccgggagcacctgacggcctccatgtcacgagtggcactccagaagtcggccagcgagcgggcggccaaggactactacaagccccgcgtgaccaagccctcgaggtcagtggatgcctatgacagctactgggagagccggaagccacccctgaaggcctcattgagtcttcggaaggagcctgtggcaacggatgtgggggacgacctcaaggatgagatcatccgcccatccccttcgctgctgaccatggccagctccccccacggcagcccggatgtgcttccacccgcctcccccagcaacggcccggccctgctgcgcggtacctacttctccactcaggatgacgtggatctgtacacagactctgaacccagggccacctaccgtcggcaggatgctctgcggccggatgtgtggctgctcagaaacgatgcccactccctctaccacaagcgctcgccccctgccaaagagtccgccctctccaagtgccaaagctgcgggctgtcctgcagctcctccctctgccagcgctgtgacagcctgctcacctgtcctccagcttccaagcccagcgccttccccagcaaggcctcgactcatgacagcctggcccacggggcatctctgcgggagaagtacccaggccagactcagggcctcgaccgcctcccgcaccttcactccaaatccaagccctccaccacgcccacttcccgctgtggcttctgcaaccgcccaggcgccaccaacacctgcacccagtgttcaaaagtctcatgtgacgcctgcctcagcgcttaccattatgacccctgctacaaaaagagtgagctgcacaagttcatgcccaacaaccagctgaactacaagtccacccagctctcccatctcgtgtacagatagaccggcctcgccccttccagctccaagggctacatcaaccgacctttcgggtttcacggtgaagaagtactaacgcattgatctcagaggcggaggcctgcacttgaccatgtaggtggcagagatcgtgggctggctgtgtccacgtgggagttcacttagcgactcagatatctcaaccaatggctgctttgttgtctgacaagggagaaggtggcacttccgttcagattcattttgctaatctctccactccctgttcagttggttctttttttggggttttgttttgttttgttttgttgttttgttttttcctttaaagaggatttctgtctctgggaccctcgctgcacctacccctcccattgcaaagccaacttggactgggaagggcccttcaggtcaccaaacatccacctggagcggcgagctagaggcctgttggcttgtgaaatgagccctcctgccacacggggcctctcccaaaggctcatcccttggccgcccccttcctaaacacaaggatccccagctggactccccaccccctggcttccccacctctccaggtgtcaaaggtgaaccgagtccagtattagctgaatgtcatttcgtacaccacagctcagtcagcccatggccttcgtgaactttgctccaacacactgatgtgtgggcttcccacagcaggactgacttccccctttctgttgtttgcacatgcccctcttactgtactgtcaatagatatttttgagatttatttttaaataaatattcaacttgctgtgtgtttcaacgtggttaaaaaaatgaattatgtagctatttattaaatgccctgggttctttagtcttccaagggagggcctcgcgcccattcgtgttgtatcctccactcactatggcccgaggggagaggagagtttggggcagggaggaacagacatgaagcctccttttcttgagctggtggagagccactgtcttccctgcagtaactatctatacacctacctccagtgtgcacttagggggtgagcgcgggtgtcgaggtctgtgtgtctgcagactgctaacctatgacaattcagggacctcacctgtcggacctatagcttgctgagcaggaaccttgcacttcacacttcttgagtctcgtttcagaaggaaaatcatttgggattcctactgcccctccatctcaatcctcttctcttcaccagtttccaggactcatctgcaacatttgcaatctttttgcactaaaagtgggcaggagtcggcatgtgcccatcagagagacggctcctcagatgctcagctaagcctaagcgcttccaagcctgaaggccccttcagcttctcatgtgaattaccaacccctggattttccttgtgggggtacaagagcaggagtggggcaagagtttgaaaataaagccgcttccttgtgaactaactatattttagccataactgtttgtgatgtacacaatgttaagggatttatatgcagtgggcttttctgggagaaagttattcagctcttgagcaagtttaagtctggctgaatcctgaggccactgtgaatttgctgatgttcttccaactcagttgagtgattttaaggttttccaaatcttctatggctctctttttaatatatatatatatatatatatatatatatatatatatatatatatatatctatctggtagatcacatgtagatgtacagtgtgtatattaagctgaatttcaaccaactttattactaagaccagcctagcagggcattcatctttgatgttcttccttttcacatttcagaatcggcaatgcctggcccactcctgagagctctagttttctagttttccatttccagattgcgccagcattacagtaactaactctttctaaccaaccgtgatgccacgtaacttaccctatggacaaaagcaggaatgactaacacatcctaggagggaaagtccagtgtacctgtcatcacggacgcactgtggtcacagactggaatacgaaatactacagccctgctcccaggtgtgcatcttactggatgaggttgctgtgattgagatagttaaatacatgctaatttaaaaatgcagatgttttacatttgatttctaccaagagttgaaatgttgagagatgattaaaaataataataataaagtgtcttccattgtt

SEQ ID NO: 29751 - DNA, 1669 bp, Homo sapiens
tttccgggccgagtgtttccgggtcgctgctggcccccgggtactggtctcagtacccctgcagccggccggagaggctagagcccgacggggcccggctccggcggcagccgcgcctctcgcttgcttccctcggccgggccgtcctcggcggcagtgtcaggacctacacgggcccttttgtttattatgtcaagtcgacattactggaagaggacatccgagccatcctgagctgcatgggctacacacctgagctgggcactgcatacaagctcagagagctcgtggagaccctccaggtgaagatggtctcctttgagctctttctggccaaagtcgagtgtgagcagatgctagaaatccactcacaagtgaaggacaagggctactccgagctggacattgtgagcgagcgcaagagcagtgcagaggatgtgcgcggctgctcggacgccctgcggcggcgggcagagggccgggagcacctgacggcctccatgtcacgagtggcactccagaagtcggccagcgagcgggcggccaaggactactacaagccccgcgtgaccaagccctcgaggtcagtggatgcctatgacagctactgggagagccggaagccacccctgaaggcctcattgagtcttcggaaggagcctgtggcaacggatgtgggggacgacctcaaggatgagatcatccgcccatccccttcgctgctgaccatggccagctccccccacggcagcccggatgtgcttccacccgcctcccccagcaacggcccggccctgctgcgcggtacctacttctccactcaggatgacgtggatctgtacacagactctgaacccagggccacctaccgtcggcaggatgctctgcggccggatgtgtggctgctcagaaacgatgcccactccctctaccacaagcgctcgccccctgccaaagagtccgccctctccaagtgccaaagctgcgggctgtcctgcagctcctccctctgccagcgctgtgacagcctgctcacctgtcctccagcttccaagcccagcgccttccccagcaaggcctcgactcatgacagcctggcccacggggcatctctgcgggagaagtacccaggccagactcagggcctcgaccgcctcccgcaccttcactccaaatccaagccctccaccacgcccacttcccgctgtggcttctgcaaccgcccaggcgccaccaacacctgcacccagtgttcaaaagtctcatgtgacgcctgcctcagcgcttaccattatgacccctgctacaaaaagagtgagctgcacaagttcatgcccaacaaccagctgaactacaagtccacccagctctcccatctcgtgtacagatagaccggcctcgccccttccagctccaagggctacatcaaccgacctttcgggtttcacggtgaagaagtactaacgcattgatctcagaggcggaggcctgcacttgaccatgtaggtggcagagatcgtgggctggctgtgtccacgtgggagttcacttagcgactcagatatctcaaccaatggctgctttgttgtctgacaagggagaaggtggcacttccgttcagattcattttgctaatctctccactccctgttcagttggttcttttttt

SEQ ID NO: 29752 - DNA, 2719 bp, Homo sapiens
acactgtcccaagtcccggcgaagacccgcccgcggctccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaagctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 29753 - DNA, 2634 bp, Homo sapiens
tccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaagctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 29754 - DNA, 2702 bp, Homo sapiens
ctgacttcccttcctgtcctcagcggccgggcccacggccccgagcagccatgctgggcgcgcgggcctggttgggccgcgtccttctgctgccccgcgccggtgcaggcctcgccgcgagccgcaggtctgcctgcagtcccacttccaggctgaactccctgaggtctctgattccctaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaagctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggt

SEQ ID NO: 29755 - DNA, 1957 bp, Homo sapiens
ttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaagctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggt

SEQ ID NO: 29756 - DNA, 2734 bp, Homo sapiens
ccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggtctgcctgcagtcccacttccaggctgaactccctgaggtctctgattccctaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaagctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggt

SEQ ID NO: 29757 - DNA, 1169 bp, Homo sapiens
gcgctgaggtctcgccccataagactccgccccgccccacgagaccgcgccgccagcaataaggcccagccccgccttctgctgttgccgcagcaacccagaaagcgtcatggctgccgccggccaggaaaaagggtatttgacacagactgcggcagccctagacaagtcaccgtcactttcgccacagctagcagctcccatccgagggaggcctaagaagtgtctggtctatccgcatgcgccgaagagctcccgcttgtctcgttccgttctgcgttggcttcagggtctggatctcagcttcttccccaggaacatcaacagagatttttcaaatggcttcctaattgcagaaatattctgtatatattacccctgggaacttgaattatcatcctttgaaaacgggacctctttaaaagtcaagttggataactgggcacagttggagaagttcctggcaagaaaaaaatttaaattacctaaagaactaatccatggaacaattcattgtaaagctggagtgcctgaaatattgatagaagaggtttacactttattaacacatcgagaaattaaaagtatccaggatgactttgtgaatttcacggactatagctaccagatgcgtttacccctggtttccaggtctacagtttcgaagtctattaaagataacattaggttatcagaattactaagcaatcccaacatgctgaccaatgaacttaaagcggagttcctcatccttttacatatgttgcaaagaaaattaggcagaaaattgaatccagaatggtttgatgtgaaaccaacagtgggagaagttactctcaatcaccttcctgcccaagcctctgggcgcagatataatttaaaagttaaaagaggaagagttgtccctgttttaccaaatataggtagtggtggcagttcacatagagaaatacatgtgaagcaagctggacaacattcttattactctgctatgaaacctatcagaaacatggacaagaaaccttgaaaagcacctgtcaaatggctttgaagaagtgatgccaccatctctagccataataaagaaacagaatcacctagtattggatgtatttcaataataaatagagtggtgtcttttccataattgtgttaaagaacatttcttt

SEQ ID NO: 29758 - DNA, 3341 bp, Homo sapiens
ttttctctcagttgaagcgcgcacattgagtcggcttttctactgcttcggctagggtaccttgtgaccatgtcttccaagaagaatagaaagcggttgaaccaaagcgcggaaaatggttcgtccttgccctctgctgcttcctcttgtgcggaggcacgggctccttctgctggatcagacttcgcggcaacctccgggactctgacggtgaccaacttattagaaaaggtagatgacaaaattcctaaaacattccagaattcccttattcatcttggactcaacactatgaagtctgcaaatatatgtataggtcgaccagtgttgcttactagtttgaacggaaagcaagaggtgtatacagcctggcctatggcaggatttcctggaggcaaggtcggcctgagtgaaatggcacagaaaaatgtgggtgtgaggcctggtgatgccatccaggtccagcctcttgtgggtgctgtgctacaggctgaggaaatggatgtggcactgagtgacaaagatatggaaattaatgaagaagaactgactggttgtatcctgagaaaactagatggcaagattgttttaccaggcaactttctgtattgtacattctatggacgaccgtacaagctgcaagtattgcgagtgaaaggggcagatggcatgatattgggagggcctcagagtgactctgacactgatgcccaaagaatggcctttgaacagtccagcatggaaaccagtagcctggagttatccttacagctaagccagttagatctggaggatacccagatcccaacatcaagaagtactccttataaaccaattgatgacagaattacaaataaagccagtgatgttttgctggatgttacacagagccctggagatggcagtggacttatgctagaggaagtcacaggtcttaaatgtaattttgaatctgccagagaaggaaatgagcaacttactgaagaagagagactgctaaagttcagcataggagcaaagtgcaatactgatactttttattttatttcttcaacaacaagagtcaattttacagagattgataaaaattcaaaagagcaagacaaccaattcaaagtaacttatgacatgataggaggattaagtagccagctgaaagcaattagagaaataattgaattgcccctcaaacagcctgagcttttcaagagttatggaattcctgcccctagaggagtgttactttatggtcctccaggtactggaaaaacaatgatcgccagggctgttgctaatgaagttggagcctatgtttctgtaattaatggtcctgaaattataagcaaattctatggtgagactgaagcaaagttacgtcagatatttgctgaagccactctacgacacccatcaattatttttattgatgagctggatgcactttgtccgaaaagagagggggcccagaatgaagtggaaaaaagagttgtggcttcactcttaacactgatggatggcattggttcagaagtaagtgaaggacaagtgttggttcttggggccacaaatcgccctcatgccttggatgctgctctccgaagacctgggcgatttgataaagagattgagattggagttcccaatgctcaggaccggctagatattctccagaaactgcttcgaagggtaccccatttgctcactgaggctgagctgctgcagctggcaaatagtgctcatggatacgttggagcagacttgaaagtcttgtgtaatgaagcaggtctctgtgccttgcggagaatcctgaaaaaacagcctaacctccctgatgtcaaggtggctggactggtgaagattactctgaaggatttcttgcaggcaatgaatgatatcagacccagtgccatgagggaaatagcaattgatgtcccaaatgtatcctggtcagatataggaggactggaaagtatcaaactgaagttggaacaggctgtggaatggcccttaaaacatccagagtctttcattcgaatgggtattcagccacctaaaggagttcttctctatgggccacctgggtgctctaaaacaatgatagcaaaggctttggccaatgagagtggactgaattttctagctataaaggggcctgaattaatgaataaatatgttggtgaatctgaaagagcagttagagagaccttccgaaaagcaagagcagtggcgccttccattattttctttgatgaactggatgccttagcagttgaaaggggcagttctttaggtgctgggaatgtagccgatcgtgttttggctcagctcttaacagaaatggatgggattgaacagctaaaggatgtgaccattttggcagctactaaccgtccagataggatagacaaggctttgatgcggcctggaagaattgatagaatcatctatgtgcctttaccggatgcagcaacaagaagggaaatatttaagctgcagtttcactccatgcctgtcagtaatgaagttgacctggatgaactcatccttcaaaccgacgcatactcaggagcagagattgtagctgtctgcagagaggcagctcttctggctctggaagaagacattcaagccaatctcatcatgaaaagacatttcactcaggccttgagcactgtgacacctagaattcctgagtcattgagacgtttttatgaagattatcaagagaagagtgggctgcatacactctgagaaaatatatatattcaagatgctgaaaatcctttccagagaaaatttgtttctttttaaaattttttgagagtgttaaaaaaaattttactaggcaaaatgtttgaagtatgttcagtagaatttaggggctttggttcttacagattttcaagtcatgtaagtacagtgaaaatatctctgagcataagtttcaatcagttttacctggaaatttgtggtgtggtttaaaaaacaaatgtttagctttttcatttgcgacctagtctgttcatcccatgaagcgatttctttttccagaatctgtttgagtgtctttctaaaatgccaaacatgttggcatcaattttatacagggatataaaaaagtatatgtggataaattttttgtaatctttagggatataaaaaagtgtatgtggataaattttttgtaatctttatttttgaaggccagccagtaaaatggcccaatgtgccagccaggcttatgtggccttgttttcaaatatacatatatgtgttatcattaaaattcatatatgcatttttgttttagccttcttaatctctacctatggccaaaaaaa

SEQ ID NO: 29759 - DNA, 818 bp, Homo sapiens
attgaacaaggtggagaaggtccagaagcataccatgaactacagaagaaggaaagatggagtaatctgatgcaactggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggatgagagagacctagagaaagatgatgaactggaactgaaaagaagtcttttatgtagagactctgcctatgacagtga

SEQ ID NO: 29760 - DNA, 2297 bp, Homo sapiens
ggatgccgaaggtgaaggcgctgcagtgcgccctggcgctggagatcagctcagtaacttgcccaggagtcgtgcttaaagacaaagaggacatctatcttagcatctgtgtgtttggccaatacaaaaagacacaatgtgtcccagccacttttcccctggtcttcaatgccagaatggtgtttgaaaaggtgttcccggacgcagtagatcctggagatgtggttacacagcttgaatatgatacagcagtgttcgagttgatacagctagttccaccagtgggtgaaacactgtctacgtatgacgaaaatacacgagatttcatgtttccgggtccaaaccaaatgtctggacaccatgattcaaaccgccaggttaccatgaggaggatttctggccttcgaggaaatgctccaaggctggaattttctacgacttcagtgattactgaatgtctgataagttcaaggaaatgccacactcaggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggatgagagagacctagagaaagatgatgaactggaactgaaaagaagtcttttatgtagagactctgcctatgacagtgaccccgagtatagctcatgtcagcagccacgtggcactttccatttggatgacggtgaatactggtccaacagggcagcctcttataagggaaaatcccaccgacccatctttgagaacagcatggacaagatgtacaggaacttatacaaaaaggcctgtagttctgcttcacatacacaggaaagcttctgagaccatccatgataaacctcattagtgtccgtgtcaatttctcaatgaaaatgtttgatgtgatcaatatctgtattcctttttttaaaaaaaatgggattataactaagtacaatagttatacttgaataagttcattacttcaaatggtaaattatcataggcaagccttttaaaataattattacagaagagtctgctgtgttacaaacattagagctctgtcacacaatcacaacttccaatatgtgacaaggatattctgttacatgtacacctcatattccatctgcaaatccaagaatagttcctttctagaaatgttttttttgccttactcaccttgcaattttcttctcatctacttaactggttatcttgcctgtgtaagatttaattaatattgactaccttttcttggtgatgaacaaaatgatatcctatacagaaatgaatttcctaagggtttaaaccctgttttcactaacattttctactttttcctttttcagaacaggctattctatttcttagctcataggctttctttttaaagactatatgatcattcactcctttttctctggaagaactgtgtaagttgcttaaaatgcatagcagttagctagaaatatcagtgccatggatgatcaaaaatttgaataactaatttttaaagataaaattctttgcatgattttttttctagggccataccttttggtgcaaccagaatcagaaaatggcctctgttagtaagcttatagaaacctaaaaataataatggaattatattgtaatttgactgcttggaatttgtgtaagtaccatatggcccaaggcactattatagtatcctcactttaaaaaaaaaaa

SEQ ID NO: 29761 - DNA, 4973 bp, Homo sapiens
gcttctccggcggaacccaggctggaccgcgggccccggcctgggggccactgctgccaccgccgccgccacctcgtctcctccccgtccccgcccagccccaggtctccccgcctcactcgggcccgtggccggggtcactccccgccgcccctccccgcacggatgccgaaggtgaaggcgctgcagtgcgccctggcgctggagatcagctcagtaacttgcccaggagtcgtgcttaaagacaaagaggacatctatcttagcatctgtgtgtttggccaatacaaaaagacacaatgtgtcccagccacttttcccctggtcttcaatgccagaatggtgtttgaaaaggtgttcccggacgcagtagatcctggagatgtggttacacagcttgaatatgatacagcagtgttcgagttgatacagctagttccaccagtgggtgaaacactgtctacgtatgacgaaaatacacgagatttcatgtttccgggtccaaaccaaatgtctggacaccatgattcaaaccgccaggttaccatgaggaggatttctggccttcgaggaaatgctccaaggctggaattttctacgacttcagtgattactgaatgtctgataagttcaaggaaatgccacactcaggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggtaaaaaatgtcttgaaatcacatcaggctcatcaaagacatttatatgatgagagagacctagagaaagatgatgaactggaactgaaaagaagtcttttatgtagagactctgcctatgacagtgaccccgagtatagctcatgtcagcagccacgtggcactttccatttggatgacggtgaatactggtccaacagggcagcctcttataagggaaaatcccaccgacccatctttgagaacagcatggacaagatgtacaggaacttatacaaaaaggcctgtagttctgcttcacatacacaggaaagcttctgagaccatccatgataaacctcattagtgtccgtgtcaatttctcaatgaaaatgtttgatgtgatcaatatctgtattcctttttttaaaaaaaatgggattataactaagtacaatagttatacttgaataagttcattacttcaaatggtaaattatcataggcaagccttttaaaataattattacagaagagtctgctgtgttacaaacattagagctctgtcacacaatcacaacttccaatatgtgacaaggatattctgttacatgtacacctcatattccatctgcaaatccaagaatagttcctttctagaaatgttttttttgccttactcaccttgcaattttcttctcatctacttaactggttatcttgcctgtgtaagatttaattaatattgactaccttttcttggtgatgaacaaaatgatatcctatacagaaatgaatttcctaagggtttaaaccctgttttcactaacattttctactttttcctttttcagaacaggctattctatttcttagctcataggctttctttttaaagactatatgatcattcactcctttttctctggaagaactgtgtaagttgcttaaaatgcatagcagttagctagaaatatcagtgccatggatgatcaaaaatttgaataactaatttttaaagataaaattctttgcatgattttttttctagggccataccttttggtgcaaccagaatcagaaaatggcctctgttagtaagcttatagaaacctaaaaataataatggaattatattgtaatttgactgcttggaatttgtgtaagtaccatatggcccaaggcactattatagtatcctcactttaaaaaaaaaaacacttggaaccacaatgtgagtaaaatattatagcagaacgctttgtggtagacactgaaaatgttgttgattgatggatagaattaacttctcctcccccaccccagcacacacctgtgaagccaatgatactataaagacataaagaaatcagctactttatatttaatagagagtgaggggagggaaaggagagtgtaggaataagtgaactgggcttatagtcttgaagagttgcctaaaagataatattttctcattgactctgtttttgattaattttacagttatgattgaaaaagaacaaaatgaacttcctttaaaatgaaattaaaatgtgaaacttgctgacttatttttgtagtagaacttgttaacatcatgttaagggtgctttagtatcacagtctgtgatatatcagaaagggcattagagctatctctatgagccaggagtcctaggctttagtatcccatgtctgccgttttctagctgagtctatttaattctcagatcctttgtttcctcagctatcaaatgataagaatgtagtagaccccaaactatgttctgtggaccaagatcactgttttaggagataatcgtaggaatgtaggtataagtatgtaattggccatctaagtttaggaaaatctgtttgctacacacatacacacacacacacacacacacacacacacacacacacctcttagagagtcatatgtaggattatagaggtaaaaagagatgatattaatgctggaatagcgcctgtaaactggggctgtctacagcaaattaggatatatggtcactgtgctcattgtgaacagtagcttgttcgaggctttaagaaaattctggtataaatctgtcttactctgcatctagtagacagcctggcatgtaattgatgttccttaaatatttatcgaattaacccagaattttctaaactaaatttagcatgtaccactatttgttattcttgccaccaccccccattcccctagctcctcacactacctgccaatgtcatcctaaggtacatgtggatacctaggttgtagaaatgctggactacacaattgctgagttactctctggctgtagattatatgatgaggtattttacaatcagcttttgaaggtcaacattgaataatgctcttttaaaaaaattatatcctcagtgtttttccatggaaaaataagtgaaaattcttttaagagttgctgtttggtgaaaagaacaaacatgactttcaaagaaaatgttttactatcaccaaaatctcccaagtgaataagtaccacagaaattacttattgcacctgtatctgccattggctgtgaaaaaggctgcaaaaagtagggctgaaagggaaactttagaaactaatactctgaaagatgttttcctatggattaaatttagtgtctttctgaaagttgggggcaaattcccagatactaatagcatctttgctaagtgtctgattatcttctatcccctaggaggaaagagtggtccatgttgctgtaactactactatgagtgcttatgctgtattgtttttaaagagtaaaacctttaagtactaatagttgtcttttctcattcacaggagcagaaaggtgcagttgtttattctcttagccttttttttttcctgtatttcccacaaatctagaaataattattggagttaatatgaaagataaataggcttttctttttactttttaatttttttctttaaatcataaaaaaccttgggatttagaaaaatgtcaaaatcgacaaataaagatgaatcattggaatgagactcttccttggttctactagctagttatataaccttatttaagtcatttatgcttcttggagctcagttttctcaccaacaaggtgataaaagggttaatttagaatgatcctttgacatttcataattgtacaattaatatgtacgatcaggaagtcctaggcaggcagagttgttttctgatttccaaagattaagcccctgatgaaaaatctggaacaaatagagaattttcattattgtgttcatttgctaataatagctttattgagatataattcactctgaaaaagtatacaattaagtggtttttactatattcacagagttgtgcaacaataaccactcactaattacagaatattttataactcccaaaagaaatcctgtaaccattagtgatcacttcccactacctcctccccacaactcctggaaaccactatatgctttttgtctccatgcctattctggacatttcatataaatggaaccatacaacatgtgacctattgtatgtggcttctttcacttagcaaaatattttgagagttcatgcatgttgtaacacgtatgaatacttcattcctttttattactaaataataatccatcatatgaatatac

SEQ ID NO: 29762 - DNA, 1635 bp, Homo sapiens
gctggaccgcgggccccggcctgggggccactgctgccaccgccgccgccacctcgtctcctccccgtccccgcccagccccaggtctccccgcctcactcgggcccgtggccggggtcactccccgccgcccctccccgcacggatgccgaaggtgaaggcgctgcagtgcgccctggcgctggagatcagctcagtaacttgcccaggagtcgtgcttaaagacaaagaggacatctatcttagcatctgtgtgtttggccaatacaaaaagacacaatgtgtcccagccacttttcccctggtcttcaatgccagaatggtgtttgaaaaggtgttcccggacgcagtagatcctggagatgtggttacacagcttgaattgggtgaaacactgtctacgtatgacgaaaatacacgagatttcatgtttccgggtccaaaccaaatgtctggacaccatgattcaaaccgccaggttaccatgaggaggatttctggccttcgaggaaatgctccaaggctggaattttctacgacttcagtgattactgaatgtctgataagttcaaggaaatgccacactcaggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggtaaaaaatgtcttgaaatcacatcaggctcatcaaagacatttatatgatgagagagacctagagaaagatgatgaactggaactgaaaagaagtcttttatgtagagactctgcctatgacagtgaccccgagtatagctcatgtcagcagccacgtggcactttccatttggatgacggtgaatactggtccaacagggcagcctcttataagggaaaatcccaccgacccatctttgagaacagcatggacaagatgtacaggaacttatacaaaaaggcctgtagttctgcttcacatacacaggaaagcttctgagaccatccatgataaacctcattagtgtccgtgtcaatttctcaatgaaaatgtttgatgtgatc

SEQ ID NO: 29763 - DNA, 1410 bp, Homo sapiens
atggatggcagccggagagtcagagcaacctctgtccttcccagatatggtccaccgtgcctatttaaaggacacttgagcaccaaaagtaatgctttttgcactgactcctcttctctcagactaagcactctccagctggtcaagaatcacatggctgttcactataataaaatcctttcagccaaagctgcagtagactgctcggttccagtaagcgtgagtaccagcataaagtatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattcagaaatgaacataaagcaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcgttctccagtgtcaaaggcgacaataatcatgacatggagttatcaactcttaaaatcatggaaatgagcattgaggactgccctttggatgtttaatcttcattaataaatacctcaaatggccagtaa

SEQ ID NO: 29764 - DNA, 1915 bp, Homo sapiens
acaatagcgactcactggacccagcccttagcaacggcctggcaacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctgcagtagactgctcggttccagtaagcgtgagtaccagcataaagtatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattcagaaatgaacataaagcaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcgggaaacttctgtgaatgtcattgaaggtgatagtgaccctgaaaaggttgagatttcaaatggattatgtggtcttaacacatcaccctcccaatctgttcagttctccagtgtcaaaggcgacaataatcatgacatggagttatcaactcttaaaatcatggaaatgagcattgaggactgccctttggatgtttaatcttcattaataaatacctcaaatggccagtaactc

SEQ ID NO: 29765 - DNA, 2123 bp, Homo sapiens
gactggggctcgatgccccttccccgccaggtctctccgtccgcaactgtcctcctagtaccgggtatcccgcaggcggggctgcggaacgcacgtcccctgcgccgtgacgtcacaatagcgactcactggacccagcccttagcaacggcctggcaacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctttttgcactgactcctcttctctcagactaagcactctccagctggtcaagaatcacatggctgttcactataataaaatcctttcagccaaagctgcagtagactgctcggttccagtaagcgtgagtaccagcataaagtatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattcagaaatgaacataaagcaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcgggaaacttctgtgaatgtcattgaaggtgatagtgaccctgaaaaggttgagatttcaaatggattatgtggtcttaacacatcaccctcccaatctgttcagttctccagtgtcaaaggcgacaataatcatgacatggagttatcaactcttaaaatcatggaaatgagcattgaggactgccctttggatgtttaatcttcattaataaatacctcaaatggccagtaac

SEQ ID NO: 29766 - DNA, 2301 bp, Homo sapiens
aacagttcatagggacagcacccccacaacagagaattatacaaccagcccaaaatgtcaatggacatttgggctgagaagtcttacatgacagaatgcttcctaccctgatctgacgttatttccaaggattcaaaggggacgtggatgccagatgagtccacctcctctccctgctcttcccgcagggacagagcctgccaggtgctggtgactcggatcctgacaggaggtcgctctgcggaagactggcaggatcccagagcaacagactggggctcgatgccccttccccgccaggtctctccgtccgcaactgtcctcctagtaccgggtatcccgcaggcggggctgcggaacgcacgtcccctgcgccgtgacgtcacaatagcgactcactggacccagcccttagcaacggcctggcaacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctgcagtagactgctcggttccagtaagcgtgagtaccagcataaagtatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattcagaaatgaacataaagcaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcgggaaacttctgtgaatgtcattgaaggtgatagtgaccctgaaaaggttgagatttcaaatggattatgtggtcttaacacatcaccctcccaatctgttcagttctccagtgtcaaaggcgacaataatcatgacatggagttatcaactcttaaaatcatggaaatgagcattgaggactgccctttggatgtttaatcttcattaataaatacctcaaatggccagtaactcaa

SEQ ID NO: 29767 - DNA, 1083 bp, Homo sapiens
agttgcgtccgttggggcttctggggcagcccacagggttccgagcatgtgctggcagttgctctttggagcacccacttcacttctcccatgtagttcctgagtgcaggactctcctgaagaaggggcgtctaaaaggccagcccatgcatcttgttcagaccaggctgctccatctccgctaagcccagggatccacttgtgtgtctttctgggataattgtctttagtggcagcctgggcctcggggaaggaagggcatgaggaatggccccggctgggatgtcaggggcccaggacaactcctgtctctaccaggaaattgccccctcttttcagaggctgccttgtcctagaacctcgtcgcgacatttctcagaagccatgacatgtccctgcggctggaggcctttcaagggtggcccaggaggcctcaagggcccggtgtggcctgcaaaggaagagaacagctgttctcacggaaggatccaaagggttcaaaggcgaagggtgccatctgcttccccactgattcagaagataaacaggagaagtgtcctgtttcacccatattgctggtcctgatttttcaatagtgtccctaccctgaagctcttccattggtcatcatggagttagctaacagcccagggaactggtctcttttcccttttcccttaccacctggaactcacctggaaagggcaatcagctggctctatatcagacgccaccacctggtctttgaagtttctgtcctaccagtgccacagctccctctcccacttctgaactacctccaagagagaccatcctcagcagcctagtatgttatgctagtcctggaatggtgtattctggatgtctactcaaggccaaaccccagtattgcctttcgtttccctattcaaggccaaggctagattctcttcattgtctccatttctctttctccagagctcctatagggcaagacactgtttctcatatatttctggatccttggagcttagctcggagcttggcatacatgcccagcatgaacttttctgaataaaataatttcaaatgctgtatacagga

SEQ ID NO: 29768 - DNA, 3158 bp, Homo sapiens
gtggctctagaaggggaggtggaggatctcctttcctcttctcagacccgggagcgtccgggacgcggagcccggagctggggcgacgaggcgattgcgggggcctgggctagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctgccgcagaaccaagtaacggcatcccagattccagtaaatcagtttccattcaagaggaacagtctgcgccttcctcagagaaaggtggtatgaatggctaccatgtcaatggtgccatcaatgacactgagtctgtggactcactcagtgaaggtttggagacactttcaatagatgccagagaattggaggatcccgagtctgccatgctagatacgctggatagaacaggatccatgctgcagaatggtgtctctgattttgagaccaagtctttgactatgcactctattcacaattctcaacaacccaggaatgctgccaaatctctctcaagacctaccacagaaactcagttttcaaatatggggatggaagatgttcccctcgccaccagtaaaaagctaagttccaatattgaaaaatctgtaaaagacctccagcgctgcacagtgtctcttgcacggtatcgagttgtagttaaagaagagatggatgcctccattaagaaaatgaaacaagcctttgctgaattggagagctgtttaatggatcgagaagtggcgttgcttgctgaaatggacaaagtgaaagctgaagcaatggaaattttgctcagccgacaaaagaaggctgaacttctaaagaagatgactcatgtggctgttcaaatgtcagagcagcaattggttgagctcagagctgatatcaagcactttgttagtgaacgtaaatatgatgaggatctgggacgagtagcccggttcacctgtgatgtagagaccctaaagaagagcattgattcatttggacaagtgtctcatccaaagaacagctattcgaccagatcccgatgtagctcagttacatctgtgtccttgagtagcccaagtgatgcctctgctgcttcctcttccacctgtgcctctcctcccagccttacaagtgctaacaagaaaaactttgcaccgggagagactcctgcagccatagcaaactccagtggccagccctaccagccacttcgggaggtattgccagggaacagacgaggaggacagggctataggccacaaggccaaaagtccaatgaccccatgaaccaagggcggcatgacagtatgggtcgttacagaaacagctcgtggtattcatctggttccaggtatcagagtgctccatctcaggcaccaggaaacaccattgaaagaggccagactcactctgcagggaccaatggaactggagtcagcatggagcccagccctcccacgccttcattcaaaaaggggctcccccagcgcaaacccaggacctctcagactgaagccgtgaactcttgagagaaaatccagttggcctctctcctctatccacacaattcaacttgataactggactttaggaaacttacagttagatgtaataacaaaaagaagtttatgcgtatcactttttgtgccattctaagtatttttggtttcttgtctccttatttcctctttaccatttttggaggggaagctattttttttccttgatctttcccagtgatatggattgaatctggttggtcatttccaccaggaatcagaggcagctgttaccaggtttcggccttccagttgatccctccactgtccaggctgtctcaggaggaggtgaatcagagctagtctgtcacctttccaatctaagccgaagccacaggtgcctgacaggttcccttctaacaactatttgaccaagagaggcaatcagggggttgtatactgcactggattcgccagagaagggaaaatttaattagtgaaaaggaaagaacactaggaaacatttgagaacctgcctctatcccagaatgtgctggagatttgacactcaaatcagtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaaggttgggcgttgtggctcatgcctgtaatcccagcactttgggaggctgaggcgggtggatcactaggtcaggagttcaagaccagcctggccaacatggtgaaaccctgtctgtactaaaaatacaaaaattagctgagcatggtggcgtgtgcctgtaatctcagctactcaggaggctgaggcaggagaatcgcttgaacccaggaggcggaggctgcagtgagctgagattgtgccactgcactccagcctgggagacagagcaagactcagtctcaaaaaaaaaaaaaaaagcatttttctgttttaatgtttggagacttttttttttgttctctccctttcctgaaccctattctgatcctgaaccaaatttatagcaatataattagtgttaatctaaggcattactcatcaaaaaaattgctgcagtctttacagttgaataaataaaaacaactgcataaata

SEQ ID NO: 29769 - DNA, 2807 bp, Homo sapiens
gtctctaaaaaaaaaaaaaaaaaagattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctgccgcagaaccaagtaacggcatcccagattccagtaaatcagtttccattcaagaggaacagtctgcgccttcctcagagaaaggtggtatgaatggctaccatgtcaatggtgccatcaatgacactgagtctgtggactcactcagtgaaggtttggagacactttcaatagatgccagagaattggaggatcccgagtctgccatgctagatacgctggatagaacaggatccatgctgcagaatggtgtctctgattttgagaccaagtctttgactatgcactctattcacaattctcaacaacccaggaatgctgccaaatctctctcaagacctaccacagaaactcagttttcaaatatggggatggaagatgttcccctcgccaccagtaaaaagctaagttccaatattgaaaaatctgtaaaagacctccagcgctgcacagtgtctcttgcacggtatcgagttgtagttaaagaagagatggatgcctccattaagaaaatgaaacaagcctttgctgaattggagagctgtttaatggatcgagaagtggcgttgcttgctgaaatggacaaagtgaaagctgaagcaatggaaattttgctcagccgacaaaagaaggctgaacttctaaagaagatgactcatgtggctgttcaaatgtcagagcagcaattggttgagctcagagctgatatcaagcactttgttagtgaacgtaaatatgatgaggatctgggacgagtagcccggttcacctgtgatgtagagaccctaaagaagagcattgattcatttggacaagtgtctcatccaaagaacagctattcgaccagatcccgatgtagctcagttacatctgtgtccttgagtagcccaagtgatgcctctgctgcttcctcttccacctgtgcctctcctcccagccttacaagtgctaacaagaaaaactttgcaccgggagagactcctgcagccatagcaaactccagtggccagccctaccagccacttcgggaggtattgccagggaacagacgaggaggacagggctataggccacaaggccaaaagtccaatgaccccatgaaccaagggcggcatgacagtatgggtcgttacagaaacagctcgtggtattcatctggttccaggtatcagagtgctccatctcaggcaccaggaaacaccattgaaagaggccagactcactctgcagggaccaatggaactggagtcagcatggagcccagccctcccacgccttcattcaaaaaggggctcccccagcgcaaacccaggacctctcagactgaagccgtgaactcttgagagaaaatccagttggcctctctcctctatccacacaattcaacttgataactggactttaggaaacttacagttagatgtaataacaaaaagaagtttatgcgtatcactttttgtgccattctaagtatttttggtttcttgtctccttatttcctctttaccatttttggaggggaagctattttttttccttgatctttcccagtgatatggattgaatctggttggtcatttccaccaggaatcagaggcagctgttaccaggtttcggccttccagttgatccctccactgtccaggctgtctcaggaggaggtgaatcagagctagtctgtcacctttccaatctaagccgaagccacaggtgcctgacaggttcccttctaacaactatttgaccaagagaggcaatcagggggttgtatactgcactggattcgccagagaagggaaaatttaattagtgaaaaggaaagaacactaggaaacatttgagaacctgcctctatcccagaatgtgctggagatttgacactcaaatcagtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaaggttgggcgttgtggctcatgcctgtaatcccagcactttgggaggctgaggcgggtggatcactaggtcaggagttcaagaccagcctggccaacatggtgaaaccctgtctgtactaaaaatacaaaaattagctgagcatggtggcgtgtgcctgtaatctcagctactcaggaggctgaggcaggagaatcgcttgaacccaggaggcggaggctgcagtgagctgagattgtgccactgcactccagcctgggagacagagcaagactcagtctcaaaaaaaaaaaaaaaagcatttttctgttttaatgtttggagacttttttttttgttctctccctttcctgaaccctattctgatcctgaaccaaatttatagcaatataattagtgttaatctaaggcattactcatcaaaaaaattgctgcagtctttacagttgaataaataaaaacaactgcataaatatgccc

SEQ ID NO: 29770 - DNA, 552 bp, Homo sapiens
cgttttccccttccatctactttgtccccaaccctctccccgagtctcttcctttccccgacccgggagcgtccgggacgcggagcccggagctggggcgacgaggcgattgcgggggcctgggctagctgctggctaccaatattctactttctgtctctatgaatgtgactaccctggttacctcatatagatggagtctcactatggtgcctactctgattttgaactcctggcttcaagcaatcctcccaccttggccttccaaagtgctgggattacagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaagg

SEQ ID NO: 29771 - DNA, 546 bp, Homo sapiens
aaccgatgccgccgggtacgagctgtgctgcacgcggacgcgagctcgcgtcccacccgttttccccttccatctactttgtccccaaccctctccccgagtctcttcctttccccgctgaggtcactagtgaactctgcttccaagtactcctgcaaagtacaccacaagcctgtctatattctcaagccatccgcttcagttcatatgaccacacttgcatgtcagcaacagaagagaacacacatcatacagcatttacagcagtggacaaagagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaagg

SEQ ID NO: 29772 - DNA, 558 bp, Homo sapiens
gatgccgccgggtacgagctgtgctgcacgcggacgcgagctcgcgtcccacccgttttccccttccatctactttgtccccaaccctctccccgagtctcttcctttccccgaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaag

SEQ ID NO: 29773 - DNA, 505 bp, Homo sapiens
agacccgggagcgtccgggacgcggagcccggagctggggcgacgaggcgattgcgggggcctgggctagagatggagtctcactatggtgcctactctgattttgaactcctggcttcaagcaatcctcccaccttggccttccaaagtgctgggattacagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaa

SEQ ID NO: 29774 - DNA, 570 bp, Homo sapiens
gtgctgcacgcggacgcgagctcgcgtcccacccgttttccccttccatctactttgtccccaaccctctccccgagtctcttcctttccccgacccgggagcgtccgggacgcggagcccggagctggggcgacgaggcgattgcgggggcctgggctagctgctggctaccaatattctactttctgtctctatgaatgtgactaccctggttacctcatatttatttgcagtgacttaaaatttggaggcaaattttccttaagaggatatcaagttccagtatcttcagatgttgataagccgttagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacaga

SEQ ID NO: 29775 - DNA, 643 bp, Homo sapiens
gcccaggagagaagtggggaggcggcggtgggggcggggcggcgtccggctctgagagagctgggggaggagcgcggcggcgacggcggcggtggctctagaaggggaggtggaggatctcctttcctcttctcagacccgggagcgtccgggacgcggagcccggagctggggcgacgaggcgattgcgggggcctgggctagttatttgcagtgacttaaaatttggaggcaaattttccttaagaggatatcaagttccagtatcttcagatgttgataagccgttagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaaggtaa

SEQ ID NO: 29776 - DNA, 570 bp, Homo sapiens
tccgtcagttcagctcgggccctccgttcccggcgcgcgccgggtccctaaccgatgccgccggctgctggctaccaatattctactttctgtctctatgaatgtgactaccctggttacctcatataatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtaca

SEQ ID NO: 29777 - DNA, 527 bp, Homo sapiens
aaccgatgccgccgggtacgagctgtgctgcacgcggacgcgagctcgcgtcccacccgttttccccttccatctactttgtccccaaccctctccccgagtctcttcctttccccgctgctggctaccaatattctactttctgtctctatgaatgtgactaccctggttacctcatataatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaa

SEQ ID NO: 29778 - DNA, 675 bp, Homo sapiens
gcgctctctcaggaggcagagcgaccgcgcggtccggaggccccagcgtttcccgtcgttggcgactctgaaattgccttttggaacaaaacttgggtcgggaaggaggcgaaggggaaagcggtgtgaagtcctcgaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctg

SEQ ID NO: 29779 - DNA, 720 bp, Homo sapiens
gaggatctcctttcctcttctcagacccgggagcgtccgggacgcggagcccggagctggggcgacgaggcgattgcgggggcctgggctagctgaggtcactagtgaactctgcttccaagtactcctgcaaagtacaccacaagcctgtctatattctcaagccatccgcttcagttcatatgaccacacttgcatgtcagcaacagaagagaacacacatcatacagcatttacagcagtggacaaagagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccag

SEQ ID NO: 29780 - DNA, 465 bp, Homo sapiens
cggagctggggcgacgaggcgattgcgggggcctgggctagctgctggctaccaatattctactttctgtctctatgaatgtgactaccctggttacctcatatttatttgcagtgacttaaaatttggaggcaaattttccttaagaggatatcaagttccagtatcttcagatgttgataagccgttagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcat

SEQ ID NO: 29781 - DNA, 2993 bp, Homo sapiens
ctcttctcagacccgggagcgtccgggacgcggagcccggagctggggcgacgaggcgattgcgggggcctgggctagctgctggctaccaatattctactttctgtctctatgaatgtgactaccctggttacctcatataatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctgccgcagaaccaagtaacggcatcccagattccagtaaatcagtttccattcaagaggaacagtctgcgccttcctcagagaaaggtggtatgaatggctaccatgtcaatggtgccatcaatgacactgagtctgtggactcactcagtgaaggtttggagacactttcaatagatgccagagaattggaggatcccgagtctgccatgctagatacgctggatagaacaggatccatgctgcagaatggtgtctctgattttgagaccaagtctttgactatgcactctattcacaattctcaacaacccaggaatgctgccaaatctctctcaagacctaccacagaaactcagttttcaaatatggggatggaagatgttcccctcgccaccagtaaaaagctaagttccaatattgaaaaatctgtaaaagacctccagcgctgcacagtgtctcttgcacggtatcgagttgtagttaaagaagagatggatgcctccattaagaaaatgaaacaagcctttgctgaattggagagctgtttaatggatcgagaagtggcgttgcttgctgaaatggacaaagtgaaagctgaagcaatggaaattttgctcagccgacaaaagaaggctgaacttctaaagaagatgactcatgtggctgttcaaatgtcagagcagcaattggttgagctcagagctgatatcaagcactttgttagtgaacgtaaatatgatgaggatctgggacgagtagcccggttcacctgtgatgtagagaccctaaagaagagcattgattcatttggacaagtgtctcatccaaagaacagctattcgaccagatcccgatgtagctcagttacatctgtgtccttgagtagcccaagtgatgcctctgctgcttcctcttccacctgtgcctctcctcccagccttacaagtgctaacaagaaaaactttgcaccgggagagactcctgcagccatagcaaactccagtggccagccctaccagccacttcgggaggtattgccagggaacagacgaggaggacagggctataggccacaaggccaaaagtccaatgaccccatgaaccaagggcggcatgacagtatgggtcgttacagaaacagctcgtggtattcatctggttccaggtatcagagtgctccatctcaggcaccaggaaacaccattgaaagaggccagactcactctgcagggaccaatggaactggagtcagcatggagcccagccctcccacgccttcattcaaaaaggggctcccccagcgcaaacccaggacctctcagactgaagccgtgaactcttgagagaaaatccagttggcctctctcctctatccacacaattcaacttgataactggactttaggaaacttacagttagatgtaataacaaaaagaagtttatgcgtatcactttttgtgccattctaagtatttttggtttcttgtctccttatttcctctttaccatttttggaggggaagctattttttttccttgatctttcccagtgatatggattgaatctggttggtcatttccaccaggaatcagaggcagctgttaccaggtttcggccttccagttgatccctccactgtccaggctgtctcaggaggaggtgaatcagagctagtctgtcacctttccaatctaagccgaagccacaggtgcctgacaggttcccttctaacaactatttgaccaagagaggcaatcagggggttgtatactgcactggattcgccagagaagggaaaatttaattagtgaaaaggaaagaacactaggaaacatttgagaacctgcctctatcccagaatgtgctggagatttgacactcaaatcagtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaaggttgggcgttgtggctcatgcctgtaatcccagcactttgggaggctgaggcgggtggatcactaggtcaggagttcaagaccagcctggccaacatggtgaaaccctgtctgtactaaaaatacaaaaattagctgagcatggtggcgtgtgcctgtaatctcagctactcaggaggctgaggcaggagaatcgcttgaacccaggaggcggaggctgcagtgagctgagattgtgccactgcactccagcctgggagacagagcaagactcagtctc

SEQ ID NO: 29782 - DNA, 3318 bp, Homo sapiens
gacggcggcggtggctctagaaggggaggtggaggatctcctttcctcttctcagacccgggagcgtccgggacgcggagcccggagctggggcgacgaggcgattgcgggggcctgggctagctgctggctaccaatattctactttctgtctctatgaatgtgactaccctggttacctcatatggaataaggagggagactgatttggaaacatctgtgaggagcaaagaggacacttactcacccccaggtccagtggtatgagagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctgccgcagaaccaagtaacggcatcccagattccagtaaatcagtttccattcaagaggaacagtctgcgccttcctcagagaaaggtggtatgaatggctaccatgtcaatggtgccatcaatgacactgagtctgtggactcactcagtgaaggtttggagacactttcaatagatgccagagaattggaggatcccgagtctgccatgctagatacgctggatagaacaggatccatgctgcagaatggtgtctctgattttgagaccaagtctttgactatgcactctattcacaattctcaacaacccaggaatgctgccaaatctctctcaagacctaccacagaaactcagttttcaaatatggggatggaagatgttcccctcgccaccagtaaaaagctaagttccaatattgaaaaatctgtaaaagacctccagcgctgcacagtgtctcttgcacggtatcgagttgtagttaaagaagagatggatgcctccattaagaaaatgaaacaagcctttgctgaattggagagctgtttaatggatcgagaagtggcgttgcttgctgaaatggacaaagtgaaagctgaagcaatggaaattttgctcagccgacaaaagaaggctgaacttctaaagaagatgactcatgtggctgttcaaatgtcagagcagcaattggttgagctcagagctgatatcaagcactttgttagtgaacgtaaatatgatgaggatctgggacgagtagcccggttcacctgtgatgtagagaccctaaagaagagcattgattcatttggacaagtgtctcatccaaagaacagctattcgaccagatcccgatgtagctcagttacatctgtgtccttgagtagcccaagtgatgcctctgctgcttcctcttccacctgtgcctctcctcccagccttacaagtgctaacaagaaaaactttgcaccgggagagactcctgcagccatagcaaactccagtggccagccctaccagccacttcgggaggtattgccagggaacagacgaggaggacagggctataggccacaaggccaaaagtccaatgaccccatgaaccaagggcggcatgacagtatgggtcgttacagaaacagctcgtggtattcatctggttccaggtatcagagtgctccatctcaggcaccaggaaacaccattgaaagaggccagactcactctgcagggaccaatggaactggagtcagcatggagcccagccctcccacgccttcattcaaaaaggggctcccccagcgcaaacccaggacctctcagactgaagccgtgaactcttgagagaaaatccagttggcctctctcctctatccacacaattcaacttgataactggactttaggaaacttacagttagatgtaataacaaaaagaagtttatgcgtatcactttttgtgccattctaagtatttttggtttcttgtctccttatttcctctttaccatttttggaggggaagctattttttttccttgatctttcccagtgatatggattgaatctggttggtcatttccaccaggaatcagaggcagctgttaccaggtttcggccttccagttgatccctccactgtccaggctgtctcaggaggaggtgaatcagagctagtctgtcacctttccaatctaagccgaagccacaggtgcctgacaggttcccttctaacaactatttgaccaagagaggcaatcagggggttgtatactgcactggattcgccagagaagggaaaatttaattagtgaaaaggaaagaacactaggaaacatttgagaacctgcctctatcccagaatgtgctggagatttgacactcaaatcagtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaaggttgggcgttgtggctcatgcctgtaatcccagcactttgggaggctgaggcgggtggatcactaggtcaggagttcaagaccagcctggccaacatggtgaaaccctgtctgtactaaaaatacaaaaattagctgagcatggtggcgtgtgcctgtaatctcagctactcaggaggctgaggcaggagaatcgcttgaacccaggaggcggaggctgcagtgagctgagattgtgccactgcactccagcctgggagacagagcaagactcagtctcaaaaaaaaaaaaaaaagcatttttctgttttaatgtttggagacttttttttttgttctctccctttcctgaaccctattctgatcctgaaccaaatttatagcaatataattagtgttaatctaaggcattactcatcaaaaaaattgctgcagtctttacagttgaataaataaaaacaactgcataaatatgc

SEQ ID NO: 29783 - DNA, 2423 bp, Homo sapiens
gcagaaacccacggctgaagcccacgatgcccatgtgtaacttggttattacacacacgtttggagcccagtgtgcagacccgcagcgcagaggaggcggcggaacaccccgggttggtcgggtttccaagggctgacccgagctccagcactttttccgcgcctgatttttcagagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 29784 - DNA, 2119 bp, Homo sapiens
acaaaacccgagagaggcgtgagcagcgctgtgtttgcgagcgggagcgaggggcgccggctggggtgtgtgctcctgagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 29785 - DNA, 2463 bp, Homo sapiens
ggaatccagtccgggggccgagctggctgcgccctccgctgcaagcgccggcagcgcggggcgagctccggacggcgcgcggcccaggcagcggctcccgctcggcccgccctccgagccgcaggggccgccaccgccgcggcgcctcccctggcgaccgcgcccccgggccccggctccggcccgggacggaggagccggcgctcgacacagagagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 29786 - DNA, 1979 bp, Homo sapiens
tttcttctgtagctgagcacttgctgggagggagtgccaaacatctcagtgtttgtgtttttagatgcactaaccaacaatagcaagcttttctccaagcatggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcat

SEQ ID NO: 29787 - DNA, 920 bp, Homo sapiens
cccgggccccggctccggcccgggacggaggagccggcgctcgacacagagagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgc

SEQ ID NO: 29788 - DNA, 2648 bp, Homo sapiens
actgcctctggaagaagagtgttatctaaagtgcttccatcatgaataatgattgagaaactgcttttactctcccgactactgtactcccaggcagaaacccacggctgaagcccacgatgcccatgtgtaacttggttattacacacacgtttggagcccagtgtgcagacccgcagcgcagaggaggcggcggaacaccccgggttggtcgggtttccaagggctgacccgagctccagcactttttccgcgcctgatttttcaggtcattttcgaatgggctatctttgcttacattttgagcttggatcctctccagaaagcattactaccttctaaaaggaaaaacatctcgtatttgcagacagtgctgagggagcaaagttcattttctcggagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 29789 - DNA, 1961 bp, Homo sapiens
attgtggagagagttatctgtgggcttgagaagctgctctgccacaccagtaaggatcagggaaagaaaatacttaggccacaccgttgcagtctttgattgcatgccagtctgaagcattttatggacccgttttgccatagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgcc

SEQ ID NO: 29790 - DNA, 2698 bp, Homo sapiens
gatttttcaggtcattttcgaatgggctatctttgcttacattttgagcttggatcctctccagaaagcattactaccttctaaaaggaaaaacatctcgtatttgcagacagtgctgagggagcaaagttcattttctcgggtaggagaagatgattctcttgcaacacgtgcggattgtgacaaaatctttcattaacaaggggagtttcggtgaagtggaggtttggggaaaggcgaggaagtcggtctggagcaagcaagcaaagtgcggaagctgtactgggattcttctagaaagtggggtgggaaaggagctagggagggcgtgtggagggacgagatctgtgtcagaacgtgcgtgtgagcggatacaaaacccgagagaggcgtgagcagcgctgtgtttgcgagcgggagcgaggggcgccggctggggtgtgtgctcctgagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttg

SEQ ID NO: 29791 - DNA, 600 bp, Homo sapiens
agagctataccttccctaagataagaaggatgaagagctggcattcactaacaggaccctgaaggcaaaaacactgggcagtttcacaaaaagggaacaagtagtctctctgaagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgc

SEQ ID NO: 29792 - DNA, 771 bp, Homo sapiens
tgtgtttgcgagcgggagcgaggggcgccggctggggtgtgtgctcctgagctcttcagaaaccaggctgctttcaggaacattgctgtggattcccaggtgaccaaggccaccaaccccctgctgattactcagccacgcccaagatcctgctactaccctggtttctggctccacattcgtcactattgagatgacttactggtcacagtaaaagcaagttgataaaggtggccagtgggggaacagagcttatgtgcctcctgagaaagccagtcgctggaaactggactgagagccctgatttggagcacgaggaaaccttaaaaaggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaacc

SEQ ID NO: 29793 - DNA, 541 bp, Homo sapiens
gtgtttgcgagcgggagcgaggggcgccggctggggtgtgtgctcctgagctcttcagaaaccaggctgctttcaggaacattgctgtggattcccaggtgaccaaggccaccaaccccctgctgattactcagccacgcccaagatcctgctactaccctggtttctggctccacattcgtcactattgagatgacttactggtcacagtaaaagcaagttgataaaggtggccagtgggggaacagagcttatgtgcctcctgagaaagccagtcgctggaaactggactgagagccctgatttggagcacgaggaaaccttaaaaattcaagcaaagtgatgtaatacccaagaacaggaaagtaaacctaagagcattaatgggtttcagagaaacgaaagtgaaactttattactgcctacacaatcaaacaggagggagaaaggagacaagcaagtcagaaagcgatttgatagggcctattccactagaagcaagatggctgaactcaatactcatgtgaatgtcaaggaaaag

SEQ ID NO: 29794 - DNA, 584 bp, Homo sapiens
gcatttcactctactgcctctggaagaagagtgttatctaaagtgcttccatcatgaataatgattgagaaactgcttttactctcccgactactgtactcccaggcagaaacccacggctgaagcccacgatgcccatgtgtaacttggttattacacacacgtttggagcccagtgtgcagacccgcagcgcagaggaggcggcggaacaccccgggttggtcgggtttccaagggctgacccgagctccagcactttttccgcgcctgatttttcagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcaggg

SEQ ID NO: 29795 - DNA, 561 bp, Homo sapiens
aaagttcattttctcgggtaggagaagatgattctcttgcaacacgtgcggattgtgacaaaatctttcattaacaaggggagtttcggtgaagtggaggtttggggaaaggcgaggaagtcggtctggagcaagcaagcaaaagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagct

SEQ ID NO: 29796 - DNA, 605 bp, Homo sapiens
attttctcgggtaggagaagatgattctcttgcaacacgtgcggattgtgacaaaatctttcattaacaaggggagtttcggtgaagtggaggtttggggaaaggcgaggaagtcggtctggagcaagcaagcaaagtgcggaagctgtactgggattcttctagaaagtggggtgggaaaggagctagggagggcgtgtggagggacgagatctgtgtcagaacgtgcgtgtgagcggatacaaaacccgagagaggcgtgagcagcgctgtgtttgcgagcgggagcgaggggcgccggctggggtgtgtgctcctgagctcttcagaaaccaggctgctttcaggaacattgctgtggattcccagctttcagacaacacatgactaagacagaatgagaccactctagttgcctcatgggaaactcgggaaaagactgcaaaaacaacattgtttctccctttggaattctggagttataaggcagaggtcccccatcttcccgaactggcctattccactagaagcaagatggctgaactcaatactcatgtgaatgtcaaggaaaagatctatgcagttagatcagttgttcccaacaa

SEQ ID NO: 29797 - DNA, 678 bp, Homo sapiens
gacttactggtcacagtaaaagcaagttgataaaggtggccagtgggggaacagagcttatgtgcctcctgagaaagccagtcgctggaaactggactgagagccctgatttggagcacgaggaaaccttaaaaaggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaa

SEQ ID NO: 29798 - DNA, 2250 bp, Homo sapiens
tttggggaaaggcgaggaagtcggtctggagcaagcaagcaaagtgcggaagctgtactgggattcttctagaaagtggggtgggaaaggagctagggagggcgtgtggagggacgagatctgtgtcagaacgtgcgtgtgagcggatacaaaacccgagagaggcgtgagcagcgctgtgtttgcgagcgggagcgaggggcgccggctggggtgtgtgctcctgggagccccctaatgaaagtcttcagtaaatagtttttctgcatgcactgattttcctgaggccattgtggagagagttatctgtgggcttgagaagctgctctgccacaccagtaaggatcagggaaagaaaatacttaggccacaccgttgcagtctttgattgcatgccagtctgaagcattttatggacccgttttgccatagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgcc

SEQ ID NO: 29799 - DNA, 835 bp, Homo sapiens
gtgtttgcgagcgggagcgaggggcgccggctggggtgtgtgctcctgagctcttcagaaaccaggctgctttcaggaacattgctgtggattcccagttcaagcaaagtgatgtaatacccaagaacaggaaagtaaacctaagagcattaatgggtttcagagaaacgaaagtgaaactttattactgcctacacaatcaaacaggagggagaaaggagacaagcaagtcagaaagcgatttgatagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagc

SEQ ID NO: 29800 - DNA, 1266 bp, Homo sapiens
ggcggagctggtcccgttgtgctgcggcgccgcgcggcctgcagtcccgggcccgcgccccgcgccgcccgcccgcccgccatggagcccggccccgacggccccgccgcctccggccccgccgccatccgcgagggctggttccgcgagacctgcagcctgtggcccggccaggccctgtcactgcaggtggagcagctgctccaccaccggcgctcgcgctaccaggacatcctcgtcttccgcagtaagacctatggcaacgtgctggtgttggacggtgtcatccagtgcacggagagagacgagttctcctaccaggagatgatcgccaacctgcctctctgcagccaccccaacccgcgaaaggtgctgatcatcgggggcggagatggaggtgtcctgcgggaggtggtgaagcacccctccgtggagtccgtggtccagtgtgagatcgacgaggatgtcatccaagtctccaagaagttcctgccaggcatggccattggctactctagctcgaagctgaccctacatgtgggtgacggttttgagttcatgaaacagaatcaggatgccttcgacgtgatcatcactgactcctcagaccccatgggccccgccgaaagtctcttcaaggagtcctattaccagctcatgaagacagccctcaaggaagatggtgtcctctgctgccagggcgagtgccagtggctgcacctggacctcatcaaggagatgcggcagttctgccagtccctgttccccgtggtggcctatgcctactgcaccatccccacctaccccagcggccagatcggcttcatgctgtgcagcaagaacccgagcacgaacttccaggagccggtgcagccgctgacacagcagcaggtggcgcagatgcagctgaagtactacaactccgacgtgcaccgcgccgcctttgtgctgcccgagtttgcccgcaaggccctgaatgatgtgagctgagcccaggcgccaccactgatgccacccaggacctcggaccttggagcctgcggggtgcctcggcccctccagccccgggccggacctcctgctggctctcgcccaccaaccaagtgttacaagccccagaatgctgcccggcctgccctgctgggcggactgtctgtgtgtctgtctctctggcgttccacctccaagcctataccagctgtgtacagcgccatctctctgccttctgttgcccctcactcaccaaacacgtgtatttatagcaaa

SEQ ID NO: 29801 - DNA, 1057 bp, Homo sapiens
gcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaaaagatctgctagaagatggttttggagagcaccccttttaccactgcctggttgcagaagtgccgaaagagcactggactccggaaggtaacccctcgccctttccagaagccagagagaccaagtgttattattttacctatgacccgtggattggcaagttattgtatcttgaggacttcttcgtgatgagtgattatagagggctttggcataggatcagaaattctgaagaatctaagccaggttgcaatgaggtgtcgctggcagcatgcacttcttgggcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgat

SEQ ID NO: 29802 - DNA, 801 bp, Homo sapiens
gcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaaaaggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatg

SEQ ID NO: 29803 - DNA, 909 bp, Homo sapiens
gcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaaaagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtc

SEQ ID NO: 29804 - DNA, 868 bp, Homo sapiens
gcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaaaaggacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaa

SEQ ID NO: 29805 - DNA, 1065 bp, Homo sapiens
gcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaaaagatctgctagaagatggttttggagagcaccccttttaccactgcctggttgcagaagtgccgaaagagcactggactccggaaggacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaattgtttggtgtaagca

SEQ ID NO: 29806 - DNA, 963 bp, Homo sapiens
agaattcgagggggtggggctatgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggagctagccgaattcgaaaaactctcggatcaggtgaagatcagtgaagaagccctgagagcagatggctttggagacaatcctttctatcactgtttggtagcagagattcttccagcgcccgggaagctactggggccctgcgtggtgggctatgggatatactatttcatctacagtacatggaagggacgcaccatttatctggaggatatctatgtgatgccggaatatcggggtcaagggattggttccaaaataatcaaaaaggtggctgaggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtc

SEQ ID NO: 29807 - DNA, 977 bp, Homo sapiens
gagggggtggggctatgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggtgaagactgcaggccggagctagccgaattcgaaaaactctcggatcaggtgaagatcagtgaagaagccctgagagcagatggctttggagacaatcctttctatcactgtttggtagcagagattcttccagcgcccgggaagctactggggccctgcgtggtgggctatgggatatactatttcatctacagtacatggaagggacgcaccatttatctggaggatatctatgtgatgccggaatatcggggtcaagggattggttccaaaataatcaaaaaggtggctgaggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctga

SEQ ID NO: 29808 - DNA, 1174 bp, Homo sapiens
ggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattgtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaat

SEQ ID NO: 29809 - DNA, 1837 bp, Homo sapiens
gtttccaccattagcgaggcctcacacccggcgctccaagttcggggctggaggcgtcccggcttcctccctcccggagcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattgtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaataattatttttaatttaaaaaagcaaatggaaaatgtatattttgatgagcttagggtgttttttttttgaaagtcagctgaaggatggttagacagcacagcgaagactgctaaatgcactgaccccccccattagaatgtgatttttgttcctttttatttctctgtgggcttttgtttttgtttttgttttggtagatcttcaatttggatatttggaggagtgaacatcgttgttttgctggagggaagatcttgatggtgtttctttccccaaaaattgacttagatattaaaatttggtgcttataagagagagttaaaaaaaaataggattgcttcaattaaaattacaaaagaga

SEQ ID NO: 29810 - DNA, 1592 bp, Homo sapiens
actcccagccggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattatttctcttacagttctggagagtcagaagttcaaaatgcgccttagagggctaaaatgaaggtgttggcagggttggttccttctggaggctcctgggaaaatctgtgttctttctttaatttcagtctcaaagccagcagtggaacagtttcaagtctctctgctcctgttgtcacattgccttccatctctgtctcctgtgtccctcttgtaaggccacttgtgattacaagtcctacctagatgatccaggattctcttcctgcttcgaaatccttaaccagttcttcaaaatccttttgccatataaagtaacattcttataaggctctggagattacatggggtggggcggggtggcagggtgggggcatttatttcacctactgcatgttgcaagataaaagtaactttacagtgcagaaattggacaacatcttgaccaggtaatgaaaatcaacatccacaagggcaggtggacgtcctgtgcctccagaggtgacactctgagaagggtctgtcaccacctatgc

SEQ ID NO: 29811 - DNA, 931 bp, Homo sapiens
cggcggtcgggcggaggccgcgctcctgctggctccgcgctccgtcccggccgcagctcggggcctgcaggggcagtcccgggtgcccgccggccgcgccgcccttccgggccctggccgtccacccgcgctcccacgcgggctcgccgccttcgcgctcccgctcggggagtccccgggctgccgggcgcgggcggaccccccatgggacgagggttgcagggactgcggcggagcgaggcgtgacccgcgcggcgagcccgggctgggggcgtgcgccgagcggggctgcccgcgcgaccttttcctgttcttgcaggcggctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggta

SEQ ID NO: 29812 - DNA, 5427 bp, Homo sapiens
ccgggaagccaccccgcctctccgaggcctccctgccccgccccgtcacgcccctttcccggcgggacgctttgagccgccccgaactaagcagggcggtcgggggagtcatactccatgggtttatgtgataaatgatcttggcatagaagagaatttaaagaatgatggaaaacctaaatgtcaaactggtggaaaatctaagaggaccattcaaggcactcataaaactactaaacagcagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaatgtgagtgctgctaacttgtccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaagggagaaggatgtccggaagtggaaggaagaattgctagatcaacgacgcaggatgatggaagaaaaattacttcatgctgagtttaagcgagaagtgcagttacaagcaattgtgaaaaaagcacaagaagaagaagctaaggtaaatgaaattgcctttataaatacccttgaagcccagaataaacgtcatgatgttttatcaaaattgaaggaatatgaacagaggcttaatgagctacaggaagagcgtcagagaagacaggaagaaaagcaagcacgtgatgaagctgtgcaggaacgcaagagagctctagaggcagagcggcaggcccgtgtagaagaattgttaatgaagaggaaagaacaagaagcccgaattgaacaacagaggcaagaaaaggaaaaagcccgtgaggatgcagcccgggaaagagctagagacagggaagaacgattggcagcactcacagctgctcaacaagaagctatggaagagttacagaaaaaaattcagctcaagcatgatgaaagtattcgaaggcacatggaacagattgaacaaagaaaagaaaaagctgctgagctaagcagtgggcgacatgcaaatactgattatgcccccaaactgaccccttatgaaagaaagaagcagtgttctctctgcaatgtcctgatctcttcagaggtatatctttttagccatgttaaagggagaaaacaccagcaagccgtgagagagaataccagcatccaggggcgtgaactgtcagatgaagaagtggagcatctttccttgaagaagtacattattgacattgtggttgaaagtacagctccagcagaagctttgaaagatggagaagagcggcaaaaaaataaaaaaaaagccaaaaagataaaagcccggatgaacttcagggctaaggaatatgagagtttaatggaaaccaaaaattctggctctgattcaccttataaagcaaagcttcagcgattagccaaagatcttctaaaacaagtacaagttcaagacagtggctcatgggcaaacaataaagtgtctgctttggatcggaccctaggagagatcactagaatactggaaaaagagaatgtggcagatcagattgcatttcaagctgctggtggattaacagcccttgaacacatccttcaagcagtagtcccagccacaaatgtgaacacagttttaagaattcctcctaagtctctctgcaatgcaatcaatgtttacaacctcacctgcaataactgttcagaaaactgcagtgatgttctgtttagtaacaagattaccttcttaatggacctcctgatacaccagttgacggtttatgttccagatgaaaataatactattttggggagaaatacaaataaacaagtttttgaaggcttgacaactggacttctcaaagtcagtgctgtggttttgggctgcctgattgccaatcgaccagatggaaactgccagccagctaccccaaaaataccaacacaggaaatgaaaaacaaaccctcacaaggtgatccttttaacaatcgagttcaggaccttatcagctacgtggtgaacatgggtctgattgacaaactgtgtgcctgcttcctctcggtgcaaggcccagtggatgagaatcccaagatggccatatttctgcagcatgccgcaggactcttacatgcaatgtgtacactgtgctttgctgtcactggaaggtcatacagcatatttgacaataatcgccaggatcccacagggctgacagctgctcttcaggcaaccgacctggctggagttcttcatatgctctactgtgtcctcttccatggcaccatcttggaccccagcactgccagtcccaaggagaattacactcaaaataccatccaagtggccattcagagtttacgtttcttcaacagctttgcagctcttcatctgcctgcttttcaggtaccaagtattggtttatatcgatgttaaccaatcaagagttagtattttagtgtagataggatgtcagattcttctcctgaattggggcataaggaataaactacaataaatggaattataatatatattataatttattaaactactattttctgggaactgtattagatgctctataacatctagcattctcatttattctcatagctaccatgcaaagtattattatacccattttacagatagagaagctgacagttaagtaatgtgcccaaggttacatgtttgtgaaccaggactagtaaccatgactctcccaccccaaagcctatgttcatcctttgccatgctgctatttataaatcttttgtctggaattctttatatcaggacattatcatctcatcaacttttaaatattaaggaaagtaatggtttcttacgtaaatagaaccaaaattagataaattgattgatatgactttctacggatggtttagctgattttgtgtccaatgtaaagtgtataactagctttacagggatttgcatctttagctatgaagtttttatagctaaagaaagaagaattgctttatgctataacaccagactgtcagcctggaaacagattttttttttcatgtaggaaatttaattttcaaaaacactgaacctttggaacagagcaagccccaaggaatagactttctctttcagtttattaactgtcaagtgatttcattaaaaaaggaacaaatttggcagatgatgaacccataatttagatgaattgctttgctctgagggaaaaaggttatagagaaacaaatgtatgaaaatagtggactttgccattctgagatgagaagaatacttctatattgtagctgatgacaaatgtgccattctttaattgatgtcttcctgtcattttgttcaaaaaaggaaacttgtgactaagttgtatcattggatctagtatctttcaactttgtagaattagtttatctgtcacaagaacagaaatcccttcctttgggttaatgcttttctgtctccagagcagttgaactagccttaggaggtaactgactgcacaatacgtagagttctgggaggttacagccacatataaatgagagatatctgctccaaaaaatgtcagtagttcttgcctcagggttgaacataacatctgtgttttatgaagacgtaagcccaccgtattctgtctggaaacagtttggaaatcagggaaccttaactttacatgctcaggatatggagtccaccagtctacccatcagctgcgtcgaaagggagtgatttcttttgttaacagattatggaatagcaaatatctaaaaactgtctcttagcttcctgtttcacgggtcttcttggccaacatttatactgctacaggggactccatatcataaacaagcatctaggataagtcagctgttcggtcagtcactccatcagggagccctaggtccctgctccctgcccctctcctcctgtgaacttgtggcctgtgcaggctcactcacaaaggcgcaccactgaacttcaccagacctgctccctagtgcctttaagcctaaagggcttaataatgggcgataatgtcaagtgatttcatt

SEQ ID NO: 29813 - DNA, 4707 bp, Homo sapiens
gagtcatactccatgggtttatgtgataaatgatcttggcatagaagagaatttaaagaatgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaattccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaagggagaaggatgtccggaagtggaaggaagaattgctagatcaacgacgcaggatgatggaagaaaaattacttcatgctgagtttaagcgagaagtgcagttacaagcaattgtgaaaaaagcacaagaagaagaagctaaggtaaatgaaattgcctttataaatacccttgaagcccagaataaacgtcatgatgttttatcaaaattgaaggaatatgaacagaggcttaatgagctacaggaagagcgtcagagaagacaggaagaaaagcaagcacgtgatgaagctgtgcaggaacgcaagagagctctagaggcagagcggcaggcccgtgtagaagaattgttaatgaagaggaaagaacaagaagcccgaattgaacaacagaggcaagaaaaggaaaaagcccgtgaggatgcagcccgggaaagagctagagacagggaagaacgattggcagcactcacagctgctcaacaagaagctatggaagagttacagaaaaaaattcagctcaagcatgatgaaagtattcgaaggcacatggaacagattgaacaaagaaaagaaaaagctgctgagctaagcagtgggcgacatgcaaatactgattatgcccccaaactgaccccttatgaaagaaagaagcagtgttctctctgcaatgtcctgatctcttcagaggtatatctttttagccatgttaaagggagaaaacaccagcaagccgtgagagagaataccagcatccaggggcgtgaactgtcagatgaagaagtggagcatctttccttgaagaagtacattattgacattgtggttgaaagtacagctccagcagaagctttgaaagatggagaagagcggcaaaaaaataaaaaaaaagccaaaaagataaaagcccggatgaacttcagggctaaggaatatgagagtttaatggaaaccaaaaattctggctctgattcaccttataaagcaaagcttcagcgattagccaaagatcttctaaaacaagtacaagttcaagacagtggctcatgggcaaacaataaagtgtctgctttggatcggaccctaggagagatcactagaatactggaaaaagagaatgtggcagatcagattgcatttcaagctgctggtggattaacagcccttgaacacatccttcaagcagtagtcccagccacaaatgtgaacacagttttaagaattcctcctaagtctctctgcaatgcaatcaatgtttacaacctcacctgcaataactgttcagaaaactgcagtgatgttctgtttagtaacaagattaccttcttaatggacctcctgatacaccagttgacggtttatgttccagatgaaaataatactattttggggagaaatacaaataaacaagtttttgaaggcttgacaactggacttctcaaagtcagtgctgtggttttgggctgcctgattgccaatcgaccagatggaaactgccagccagctaccccaaaaataccaacacaggaaatgaaaaacaaaccctcacaaggtgatccttttaacaatcgagttcaggaccttatcagctacgtggtgaacatgggtctgattgacaaactgtgtgcctgcttcctctcggtgcaaggcccagtggatgagaatcccaagatggccatatttctgcagcatgccgcaggactcttacatgcaatgtgtacactgtgctttgctgtcactggaaggtcatacagcatatttgacaataatcgccaggatcccacagggctgacagctgctcttcaggcaaccgacctggctggagttcttcatatgctctactgtgtcctcttccatggcaccatcttggaccccagcactgccagtcccaaggagaattacactcaaaataccatccaagtggccattcagagtttacgtttcttcaacagctttgcagctcttcatctgcctgcttttcagtctattgtaggggcagagggcttgtcccttgcattccggcacatggccagctccctgctgggccactgcagccaagtctcctgtgaaagcctccttcatgaggtcatcgtctgtgtgggctacttcactgtcaaccacccagataaccaggtgatcgtgcagtccggccgccaccccacagtgctgcagaagctctgccagttgcccttccagtatttcagtgacccacggctgatcaaagtactgttcccttcacttatcgctgcttgttacaacaaccatcagaacaagatcattctggagcaagagatgagctgtgttttactggccactttcattcaggatttggcacagactccaggtcaagcggaaaaccagccttaccaacccaaagggaaatgccttggttcccaagactatcttgagctggctaacagatttcctcagcaggcctgggaagaagctcgacagtttttcttgaaaaaagagaaaaaataaatgttttggttgattctgtatttgagtacccttgttaatattttaaattgtccaaacaaacattctaattgttccttaagaactcattttcccatgtttatactcttcccacactgtagatatggcatgtactttacactatttataatgactgtagatacttgaatgttctacttgctaattttgcaagttgagtttatttcatttatgcagagtatcttggagtttggtaatttccatcttatgataatatatactttgcatttgtgatatgggtgaaaggagacataaaattagcaagtctgttttgttcttgtaataaagtaacttattctgttttcattgttgacttttcatgttaaggaaatacgaatctgaaagaaaaatgttaactccagctcttgaagtatcttaaataaagacttaattaaagtttacctgctct

SEQ ID NO: 29814 - DNA, 4850 bp, Homo sapiens
acttctccttcctgctgccttgtaaagaaggcgccttgcttgcccttctccttccaccatgattgcaagtttcctgaggcctccccagccatgctgaactgaaaacctaaatgtcaaactggtggaaaatctaagaggaccattcaaggcactcataaaactactaaacagctctttgaggaatcgccatacttctttccataatggccgaactaatttacactcccagcaatagcgtagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgtgaccagcttccatcctgaagccacctaggggctgccagccacttgtcaactcattagcatacaaaaagacacatcattttgggaattccaaagattttaggagttgcatgccaggagacttgagatgaagaccaaatatatattttgcaatatcacagaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaattccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaagggagaaggatgtccggaagtggaaggaagaattgctagatcaacgacgcaggatgatggaagaaaaattacttcatgctgagtttaagcgagaagtgcagttacaagcaattgtgaaaaaagcacaagaagaagaagctaaggtaaatgaaattgcctttataaatacccttgaagcccagaataaacgtcatgatgttttatcaaaattgaaggaatatgaacagaggcttaatgagctacaggaagagcgtcagagaagacaggaagaaaagcaagcacgtgatgaagctgtgcaggaacgcaagagagctctagaggcagagcggcaggcccgtgtagaagaattgttaatgaagaggaaagaacaagaagcccgaattgaacaacagaggcaagaaaaggaaaaagcccgtgaggatgcagcccgggaaagagctagagacagggaagaacgattggcagcactcacagctgctcaacaagaagctatggaagagttacagaaaaaaattcagctcaagcatgatgaaagtattcgaaggcacatggaacagattgaacaaagaaaagaaaaagctgctgagctaagcagtgggcgacatgcaaatactgattatgcccccaaactgaccccttatgaaagaaagaagcagtgttctctctgcaatgtcctgatctcttcagaggtatatctttttagccatgttaaagggagaaaacaccagcaagccgtgagagagaataccagcatccaggggcgtgaactgtcagatgaagaagtggagcatctttccttgaagaagtacattattgacattgtggttgaaagtacagctccagcagaagctttgaaagatggagaagagcggcaaaaaaataaaaaaaaagccaaaaagataaaagcccggatgaacttcagggctaaggaatatgagagtttaatggaaaccaaaaattctggctctgattcaccttataaagcaaagcttcagcgattagccaaagatcttctaaaacaagtacaagttcaagacagtggctcatgggcaaacaataaagtgtctgctttggatcggaccctaggagagatcactagaatactggaaaaagagaatgtggcagatcagattgcatttcaagctgctggtggattaacagcccttgaacacatccttcaagcagtagtcccagccacaaatgtgaacacagttttaagaattcctcctaagtctctctgcaatgcaatcaatgtttacaacctcacctgcaataactgttcagaaaactgcagtgatgttctgtttagtaacaagattaccttcttaatggacctcctgatacaccagttgacggtttatgttccagatgaaaataatactattttggggagaaatacaaataaacaagtttttgaaggcttgacaactggacttctcaaagtcagtgctgtggttttgggctgcctgattgccaatcgaccagatggaaactgccagccagctaccccaaaaataccaacacaggaaatgaaaaacaaaccctcacaaggtgatccttttaacaatcgagttcaggaccttatcagctacgtggtgaacatgggtctgattgacaaactgtgtgcctgcttcctctcggtgcaaggcccagtggatgagaatcccaagatggccatatttctgcagcatgccgcaggactcttacatgcaatgtgtacactgtgctttgctgtcactggaaggtcatacagcatatttgacaataatcgccaggatcccacagggctgacagctgctcttcaggcaaccgacctggctggagttcttcatatgctctactgtgtcctcttccatggcaccatcttggaccccagcactgccagtcccaaggagaattacactcaaaataccatccaagtggccattcagagtttacgtttcttcaacagctttgcagctcttcatctgcctgcttttcagtctattgtaggggcagagggcttgtcccttgcattccggcacatggccagctccctgctgggccactgcagccaagtctcctgtgaaagcctccttcatgaggtcatcgtctgtgtgggctacttcactgtcaaccacccagataaccaggtgatcgtgcagtccggccgccaccccacagtgctgcagaagctctgccagttgcccttccagtatttcagtgacccacggctgatcaaagtactgttcccttcacttatcgctgcttgttacaacaaccatcagaacaagatcattctggagcaagagatgagctgtgttttactggccactttcattcaggatttggcacagactccaggtcaagcggaaaaccagccttaccaacccaaagggaaatgccttggttcccaagactatcttgagctggctaacagatttcctcagcaggcctgggaagaagctcgacagtttttcttgaaaaaagagaaaaaataaatgttttggttgattctgtatttgagtacccttgttaatattttaaattgtccaaacaaacattctaattgttccttaagaactcattttcccatgtttatactcttcccacactgtagatatggcatgtactttacactatttataatgactgtagatacttgaatgttctacttgctaattttgcaagttgagtttatttcatttatgcagagtatcttggagtttggtaatttccatcttatgataatatatactttgcatttgtgatatgggtgaaaggagacataaaattagcaagtctgttttgttcttgtaataaagtaacttattctgttttcattgttgacttttcatgttaaggaaatacgaatctgaaagaaaaatgttaactccagctcttgaagtatcttaaataaagacttaattaaagtttacctgctct

SEQ ID NO: 29815 - DNA, 4747 bp, Homo sapiens
gctttgagccgccccgaactaagcagggcggtcgggggagtcatactccatgggtttatgtgataaatgatcttggcatagaagagaatttaaagaatgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaattccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaagggagaaggatgtccggaagtggaaggaagaattgctagatcaacgacgcaggatgatggaagaaaaattacttcatgctgagtttaagcgagaagtgcagttacaagcaattgtgaaaaaagcacaagaagaagaagctaaggtaaatgaaattgcctttataaatacccttgaagcccagaataaacgtcatgatgttttatcaaaattgaaggaatatgaacagaggcttaatgagctacaggaagagcgtcagagaagacaggaagaaaagcaagcacgtgatgaagctgtgcaggaacgcaagagagctctagaggcagagcggcaggcccgtgtagaagaattgttaatgaagaggaaagaacaagaagcccgaattgaacaacagaggcaagaaaaggaaaaagcccgtgaggatgcagcccgggaaagagctagagacagggaagaacgattggcagcactcacagctgctcaacaagaagctatggaagagttacagaaaaaaattcagctcaagcatgatgaaagtattcgaaggcacatggaacagattgaacaaagaaaagaaaaagctgctgagctaagcagtgggcgacatgcaaatactgattatgcccccaaactgaccccttatgaaagaaagaagcagtgttctctctgcaatgtcctgatctcttcagaggtatatctttttagccatgttaaagggagaaaacaccagcaagccgtgagagagaataccagcatccaggggcgtgaactgtcagatgaagaagtggagcatctttccttgaagaagtacattattgacattgtggttgaaagtacagctccagcagaagctttgaaagatggagaagagcggcaaaaaaataaaaaaaaagccaaaaagataaaagcccggatgaacttcagggctaaggaatatgagagtttaatggaaaccaaaaattctggctctgattcaccttataaagcaaagcttcagcgattagccaaagatcttctaaaacaagtacaagttcaagacagtggctcatgggcaaacaataaagtgtctgctttggatcggaccctaggagagatcactagaatactggaaaaagagaatgtggcagatcagattgcatttcaagctgctggtggattaacagcccttgaacacatccttcaagcagtagtcccagccacaaatgtgaacacagttttaagaattcctcctaagtctctctgcaatgcaatcaatgtttacaacctcacctgcaataactgttcagaaaactgcagtgatgttctgtttagtaacaagattaccttcttaatggacctcctgatacaccagttgacggtttatgttccagatgaaaataatactattttggggagaaatacaaataaacaagtttttgaaggcttgacaactggacttctcaaagtcagtgctgtggttttgggctgcctgattgccaatcgaccagatggaaactgccagccagctaccccaaaaataccaacacaggaaatgaaaaacaaaccctcacaaggtgatccttttaacaatcgagttcaggaccttatcagctacgtggtgaacatgggtctgattgacaaactgtgtgcctgcttcctctcggtgcaaggcccagtggatgagaatcccaagatggccatatttctgcagcatgccgcaggactcttacatgcaatgtgtacactgtgctttgctgtcactggaaggtcatacagcatatttgacaataatcgccaggatcccacagggctgacagctgctcttcaggcaaccgacctggctggagttcttcatatgctctactgtgtcctcttccatggcaccatcttggaccccagcactgccagtcccaaggagaattacactcaaaataccatccaagtggccattcagagtttacgtttcttcaacagctttgcagctcttcatctgcctgcttttcagtctattgtaggggcagagggcttgtcccttgcattccggcacatggccagctccctgctgggccactgcagccaagtctcctgtgaaagcctccttcatgaggtcatcgtctgtgtgggctacttcactgtcaaccacccagataaccaggtgatcgtgcagtccggccgccaccccacagtgctgcagaagctctgccagttgcccttccagtatttcagtgacccacggctgatcaaagtactgttcccttcacttatcgctgcttgttacaacaaccatcagaacaagatcattctggagcaagagatgagctgtgttttactggccactttcattcaggatttggcacagactccaggtcaagcggaaaaccagccttaccaacccaaagggaaatgccttggttcccaagactatcttgagctggctaacagatttcctcagcaggcctgggaagaagctcgacagtttttcttgaaaaaagagaaaaaataaatgttttggttgattctgtatttgagtacccttgttaatattttaaattgtccaaacaaacattctaattgttccttaagaactcattttcccatgtttatactcttcccacactgtagatatggcatgtactttacactatttataatgactgtagatacttgaatgttctacttgctaattttgcaagttgagtttatttcatttatgcagagtatcttggagtttggtaatttccatcttatgataatatatactttgcatttgtgatatgggtgaaaggagacataaaattagcaagtctgttttgttcttgtaataaagtaacttattctgttttcattgttgacttttcatgttaaggaaatacgaatctgaaagaaaaatgttaactccagctcttgaagtatcttaaataaagacttaattaaagtttacctgctctaaa

SEQ ID NO: 29816 - DNA, 1537 bp, Homo sapiens
aagggaaggaagtaagggcgagcccgtcggactacgaagcgggacggaaactacaattcccagcaggccttgggcctcagtgcggccgcgaagcagagcgggctgtagagccttgcgcgcgcagtggggatggaacgttgctaggcttagcgggtctggctgctgggggcccgagcagcacgctcggagccgccgcgcgccaaagcgggaatctgggaggcgagcagctctgcagttaatgcacgtattttaaactcccgggcctgcggacgctatgcacaggaagcacctccaggagattccagacctgagtagcaacgttgccaccagcttcacgtggggatgggattccagcaagacttctgaactgctgtcaggcatgggggtctccgccctggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccaggtgtttcatgggactcccttccggatgagctgctcttgggaatcttttcctgtctgtgcctccctgagctgctaaaggtctctggtgtttgtaagaggtggtatcgcctagcgtctgatgagtctctatggcagaccttagacctcacaggtaaaaatctgcacccggatgtgactggtcggttgctgtctcaaggggtgattgccttccgctgcccacgatcatttatggaccaaccattggctgaacatttcagcccttttcgtgtacagcacatggacctatcgaactcagttatagaagtgtccaccctccacggcatactgtctcagtgttccaagttgcagaatctaagcctggaaggcctgcggctttcggatcccattgtcaatactctcgcaaaaaactcaaatttagtgcgacttaacctttctgggtgttctggattctctgaatttgccctgcagactttgctaagcagctgttccagactggatgagctgaacctctcctggtgttttgatttcactgaaaagcatgtacaggtggctgttgcgcatgtgtcagagaccatcacccagctgaatcttagcggctacagaaagaatctccagaaatcagatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttactattagtgacaagagctggggttaggatccggttggactctgacatcggatgccctcaaacatacagaacttccaaactcaagtccagccataagctattttgccaacatgtcagagtaatctgtatttttgtatgtgatttctacttttatagacttgttttaaaacaataaaacacatttttataaaaatgagtgcttaaa

SEQ ID NO: 29817 - DNA, 3759 bp, Homo sapiens
agtgcggccgcgaagcagagcgggctgtagagccttgcgcgcgcagtggggatggaacgttgctaggcttagcgggtctggctgctgggggcccgagcagcacgctcggagccgccgcgcgccaaagcgggaatctgggaggcgagcagctctgcagttaatgcacgtattttaaactcccgggcctgcggacgctatgcacaggaagcacctccaggagattccagacctgagtagcaacgttgccaccagcttcacgtggggatgggattccagcaagacttctgaactgctgtcaggcatgggggtctccgccctggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccaggtgtttcatgggactcccttccggatgagctgctcttgggaatcttttcctgtctgtgcctccctgagctgctaaaggtctctggtgtttgtaagaggtggtatcgcctagcgtctgatgagtctctatggcagaccttagacctcacaggtaaaaatctgcacccggatgtgactggtcggttgctgtctcaaggggtgattgccttccgctgcccacgatcatttatggaccaaccattggctgaacatttcagcccttttcgtgtacagcacatggacctatcgaactcagttatagaagtgtccaccctccacggcatactgtctcagtgttccaagttgcagaatctaagcctggaaggcctgcggctttcggatcccattgtcaatactctcgcaaaaaactcaaatttagtgcgacttaacctttctgggtgttctggattctctgaatttgccctgcagactttgctaagcagctgttccagactggatgagctgaacctctcctggtgttttgatttcactgaaaagcatgtacaggtggctgttgcgcatgtgtcagagaccatcacccagctgaatcttagcggctacagaaagaatctccagaaatcagatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttacttgaacttggagaaattcccacactaaaaacactacaagtttttggaatcgtgccagatggtacccttcaactgttaaaggaagcccttcctcatctacagattaattgctcccatttcaccaccattgccaggccaactattggcaacaaaaagaaccaggagatatggggcatcaaatgccgactgacactgcaaaagcccagttgtctatgaagtatttattgcaggatggtgtctcttctttagaacagggaaaataggcaggaagcccaattgctggagtacttagctagttttattcttggttttccctttgccttcattctgcaagtatactagggagccatttgagagggaaaactatgaaatcttgctttttgaaatgattctaaaagcttctatcactgctttgctcttaagagccaaagttgtaggccttttgaaattttaggagagtgagcctataatttcaagataccttaaagagcaaaatttgagccacctcttccaagtgcccttcttactaagtctattcagaatcaagcttaaaaattaccaccagcaaacaatcttcatagcccatataacttttatctatttaattttatagtattgctttataagacagcttagaagaacaataagctatttgtattatgagctgaacaaaaagagaatcataggatagtagcgtctgaggccatcttttctaggaataggaaagagaaaaatgtatttgaattttgcctttagatttgaaattaggttaatagaaataagtaaccccatgtaattcaccttaaaacttaacaaaagaccaaacattacaaaacccagagatatagaatcaatataggatttgaaggcccagcagacagttttctatgacaggttaatctgaagtatcctgtaatgttcattaagttactgtgtttccagaatctaaattagatgagaaatataattgtggttttctaacttgataatcaaattatgttaacatgggtcctttagcttttaaaatgacttgctttgttttagaaaggtggtattaatccactctctattcttgaaaatttggatgggagaattctgaagttgcctgctgttttcctttagcgctgaggttcttaaggttacttttatattactctggaatcaagtattttaaattgtattttttttttaaatgatctctcagcaataattgtttgaaactatccatatataaggttatcagacctacagttccctaagaggaactgcatgttctcttcaatcagaaatatacagtagaagcaggtatatcttccatgcagtttcagtagtaagcactacttatacctacataagagttaaaatccagatgtgggaccttttgataccatcagtgatatatatttttttaaactggtacagagaagtgaaaagattaaattctacttctattttttttttttttttttgagacggagtctcgctctgtcaccaaggccggagtgcagtggtgcgatctcggctcactgcaagctccgcctcccaggttcacgtcattctcctgcctcagcctcccgactagctgggactacaggcgcccaccaccacgcccggctaatttttttgtatttttagtagagacggggtttcaccatgttagccaggatggtctcaatctcctgacctcatgatccgcccgtcttggcctcccaaagtgctgggattacaggcatgagcaactgcgcccagccaaattctacttcttaaaaatcacaaaaactagtttaaattgatgacttgttcgtatgttcaaaatgtaacaacaaaaaaagctaacaccagtcatttatattaactttttttttttaaatcaaaaattgttaatgttagaaacatactatgaagtgcctttatctgcttagacctaaggaagattttaaagttgggttgcacaggaaatgatgatgcttcaatttcttaatagttaaaaagtgctaaatactacttgaaattattgtttacagattagtgacaagagctggggttaggatccggttggactctgacatcggatgccctcaaacatacagaacttccaaactcaagtccagccataagctattttgccaacatgtcagagtaatctgtatttttgtatgtgatttctacttttatagacttgttttaaaacaataaaacacatttttataaaaatgagtgcttaaactaagttgtattccttttttctttctctttttttaagtgctgtggttaaaatttgaaagcatttagtgtggtatgccatttggcttagatacctctaaataagactcttcaaaacagagccctgagatggtcctttttgacccatctacttcatatgcttgtcacattaaaaaaaaaagtttataatgcctttataaaaggggctaatacagtcttgttatctttttttttaaattatactttaagttctagggtacatgtgcacaacgtgcaggttt

SEQ ID NO: 29818 - DNA, 1409 bp, Homo sapiens
agtgcggccgcgaagcagagcgggctgtagagccttgcgcgcgcagtggggatggaacgttgctaggcttagcgggtctggctgctgggggcccgagcagcacgctcggagccgccgcgcgccaaagcgggaatctgggaggcgagcagctctgcagttaatgcacgtattttaaactcccgggcctgcggacgctatgcacaggaagcacctccaggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccaggtgtttcatgggactcccttccggatgagctgctcttgggaatcttttcctgtctgtgcctccctgagctgctaaaggtctctggtgtttgtaagaggtggtatcgcctagcgtctgatgagtctctatggcagaccttagacctcacaggtaaaaatctgcacccggatgtgactggtcggttgctgtctcaaggggtgattgccttccgctgcccacgatcatttatggaccaaccattggctgaacatttcagcccttttcgtgtacagcacatggacctatcgaactcagttatagaagtgtccaccctccacggcatactgtctcagtgttccaagttgcagaatctaagcctggaaggcctgcggctttcggatcccattgtcaatactctcgcaaaaaactcaaatttagtgcgacttaacctttctgggtgttctggattctctgaatttgccctgcagactttgctaagcagctgttccagactggatgagctgaacctctcctggtgttttgatttcactgaaaagcatgtacaggtggctgttgcgcatgtgtcagagaccatcacccagctgaatcttagcggctacagaaagaatctccagaaatcagatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttacttgaacttggagaaattcccacactaaaaacactacaagtttttggaatcgtgccagatggtacccttcaactgttaaaggaagcccttcctcatctacagattaattgctcccatttcaccaccattgccaggccaactattggcaacaaaaagaaccaggagatatggggcatcaaatgccgactgacactgcaaaagcccagttgtctatgaagtatttattgcaggatggtgtctcttctttagaacaggg

SEQ ID NO: 29819 - DNA, 1646 bp, Homo sapiens
gctaggcttagcgggtctggctgctgggggcccgagcagcacgctcggagccgccgcgcgccaaagcgggaatctgggaggcgagcagctctgcagttaatgcacgtattttaaactcccgggcctgcggacgctatgcacaggaagcacctccaggagattccagacctgagtagcaacgttgccaccagcttcacgtggggatgggattccagcaagacttctgaactgctgtcaggcatgggggtctccgccctggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccaggtctgatgagtctctatggcagaccttagacctcacaggtaaaaatctgcacccggatgtgactggtcggttgctgtctcaaggggtgattgccttccgctgcccacgatcatttatggaccaaccattggctgaacatttcagtactctcgcaaaaaactcaaatttagtgcgacttaacctttctgggtgttctggattctctgaatttgccctgcagactttgctaagcagctgttccagactggatgagctgaacctctcctggtgttttgatttcactgaaaagcatgtacaggtggctgttgcgcatgtgtcagagaccatcacccagctgaatcttagcggctacagaaagaatctccagaaatcagatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttacttgaacttggagaaattcccacactaaaaacactacaagtttttggaatcgtgccagatggtacccttcaactgttaaaggaagcccttcctcatctacagattaattgctcccatttcaccaccattgccaggccaactattggcaacaaaaagaaccaggagatatggggcatcaaatgccgactgacactgcaaaagcccagttgtctatgaagtatttattgcaggatggtgtctcttctttagaacagggaaaataggcaggaagcccaattgctggagtacttagctagttttattcttggttttccctttgccttcattctgcaagtatactagggagccatttgagagggaaaactatgaaatcttgctttttgaaatgattctaaaagcttctatcactgctttgctcttaagagccaaagttgtaggccttttgaaattttaggagagtgagcctataatttcaagataccttaaagagcaaaatttgagccacctcttccaagtgcccttcttactaagtctattcagaatcaagcttaaaaattaccaccagcaaacaatcttcatagcccatataacttttatctatttaattttatagtattgctttataagacagcttagaagaacaataagctatttgtattatgagctgaacaaaaagagaatcataggatagtagcgtct

SEQ ID NO: 29820 - DNA, 1851 bp, Homo sapiens
cgctaaacagcagctgaaggtcaggcgaactgactcgctgcggaatctgcctttgcacgtgatcagtcggacgtctacacccgcagccgtcttctgtctccgcctcaccctcaggcctgacggtccgagtggagctgcgggacagcccgaacctccaggtcagccccgcggccctccatggcgctggtgcgcgcactcgtctgctgcctgctgactgcctggcactgccgctccggcctcgggctgcccgtggcgcccgcaggcggcaggaatcctcctccggcgataggacagttttggcatgtgactgacttacacttagaccctacttaccacatcacagatgaccacacaaaagtgtgtgcttcatctaaaggtgcaaatgcctccaaccctggcccttttggagatgttctgtgtgattctccatatcaacttattttgtcagcatttgattttattaaaaattctggacaagaagcatctttcatgatatggacaggggatagcccacctcatgttcctgtacctgaactctcaacagacactgttataaatgtgatcactaatatgacaaccaccatccagagtctctttccaaatctccaggttttccctgcgctgggtaatcatgactattggccacaggatcaactgcctgtagtcaccagtaaagtgtacaatgcagtagcaaacctctggaaaccatggctagatgaagaagctattagtactttaaggaaaggtggtttttattcacagaaagttacaactaatccaaaccttaggatcatcagtctaaacacaaacttgtactacggcccaaatataatgacactgaacaagactgacccagccaaccagtttgaatggctagaaagtacattgaacaactctcagcagaataaggagaaggtgtatatcatagcacatgttccagtggggtatctgccatcttcacagaacatcacagcaatgagagaatactataatgagaaattgatagatatttttcaaaaatacagtgatgtcattgcaggacaattttatggacacactcacagagacagcattatggttctttcagataaaaaaggaagtccagtaaattctttgtttgtggctcctgctgttacaccagtgaagagtgttttagaaaaacagaccaacaatcctggtatcagactgtttcagtatgatcctcgtgattataaattattggatatgttgcagtattacttgaatctgacagaggcgaatctaaagggagagtccatctggaagctggagtatatcctgacccagacctacgacattgaagatttgcagccggaaagtttatatggattagctaaacaatttacaatcctagacagtaagcagtttataaaatactacaattacttctttgtgagttatgacagcagtgtaacatgtgataagacatgtaaggcctttcagatttgtgcaattatgaatcttgataatatttcctatgcagattgcctcaaacagctttatataaagcacaattactagtatttcacagtttttgctaatagaaaatgctgattctgattctgagatcaatttgtgggaattttacataaatctttgttaattactgagtgggcaagtagacttcctgtctttgctttctttttttttttctttttgatgccttaatgtagatatctttatcattctgaattgtattatatatttaaagtgctcattaatagaatgatggatgtaaattggatgtaaatattcagtttatataattatatctaatttgtacccttgttgaaattgtcatttatacaataaagcgaattctttatctctaaa

SEQ ID NO: 29821 - DNA, 1478 bp, Homo sapiens
aggtcagccccgcggccctccatggcgctggtgcgcgcactcgtctgctgcctgctgactgcctggcactgccgctccggcctcgggctgcccgtggcgcccgcaggcggcaggaatcctcctccggcgatagggatagcccacctcatgttcctgtacctgaactctcaacagacactgttataaatgtgatcactaatatgacaaccaccatccagagtctctttccaaatctccaggttttccctgcgctgggtaatcatgactattggccacaggatcaactgcctgtagtcaccagtaaagtgtacaatgcagtagcaaacctctggaaaccatggctagatgaagaagctattagtactttaaggaaaggtggtttttattcacagaaagttacaactaatccaaaccttaggatcatcagtctaaacacaaacttgtactacggcccaaatataatgacactgaacaagactgacccagccaaccagtttgaatggctagaaagtacattgaacaactctcagcagaataaggagaaggtgtatatcatagcacatgttccagtggggtatctgccatcttcacagaacatcacagcaatgagagaatactataatgagaaattgatagatatttttcaaaaatacagtgatgtcattgcaggacaattttatggacacactcacagagacagcattatggttctttcagataaaaaaggaagtccagtaaattctttgtttgtggctcctgctgttacaccagtgaagagtgttttagaaaaacagaccaacaatcctggtatcagactgtttcagtatgatcctcgtgattataaattattggatatgttgcagtattacttgaatctgacagaggcgaatctaaagggagagtccatctggaagctggagtatatcctgacccagacctacgacattgaagatttgcagccggaaagtttatatggattagctaaacaatttacaatcctagacagtaagcagtttataaaatactacaattacttctttgtgagttatgacagcagtgtaacatgtgataagacatgtaaggcctttcagatttgtgcaattatgaatcttgataatatttcctatgcagattgcctcaaacagctttatataaagcacaattactagtatttcacagtttttgctaatagaaaatgctgattctgattctgagatcaatttgtgggaattttacataaatctttgttaattactgagtgggcaagtagacttcctgtctttgctttctttttttttttctttttgatgccttaatgtagatatctttatcattctgaattgtattatatatttaaagtgctcattaatagaatgatggatgtaaattggatgtaaatattcagtttatataattatatctaatttgtacccttgttgaaattgtcatttatacaataaagcgaattctttatctct

SEQ ID NO: 29822 - DNA, 1013 bp, Homo sapiens
gccaaacaagtctctgctcatgaggccccacaggatgaacgagccgaggcaggacagtgtcctgccctgtcggaacagtgactgctgacctgccaagagagagctggggactgcctgctgtctgccagtacaatgaaggaagtggtttattggtcacccaagaaggtggcagactggctgctggagaatgctatgccagaatactgtgagcctctggagcatttcacaggccaggacttgatcaacctaacccaagaggatttcaaaaaaccccccttgtgccgagtctcctctgacaatgggcagcggctcctggacatgatagaaaccctgaaaatggagcaccatttggaagcacacaagaacggccatgccaatgggcacctcaacattggcgtagacatccccacccccgacggcagcttcagcatcaagattaaacccaacgggatgccaaatgggtataggaaagagatgataaagatccccatgccagaactggagcgctctcagtaccccatggagtggggcaagacttttctggcctttctttatgcactttcctgtttcgttctcaccacagtgatgatctcggtcgtccacgaacgagtacctcctaaggaggtgcagcctccactaccggacacattttttgaccattttaaccgggtgcagtgggccttttctatttgtgaaattaatggcatgatccttgtaggactctggttaattcagtggctgctcttaaaatacaaggatgtgggaaatgaaagcagagtcgtcatgatcttcctaagcatcgtccaccctgtccttctactggggtccatcgctggtttcctgtctctctccctgtgacctctcttcagtgtatctggcccaccagacagaattggactttcaagccactgactaggaaaaattcctgggaaatctctgcatttgtgtcagacttcactgcaaaacaggtctattattagcagaagatttttctgcatagttggcacgctgta

SEQ ID NO: 29823 - DNA, 3744 bp, Homo sapiens
tcgggcagcggactgggcatgctcggcagcccgggaggctcgcggtggcaagtcgaaagcgttcgcaccagcggggcagcggctgcgggcggcaggcggcgggcaggtcgggagtgagaaggaccggcctgggctgactgctctcccctcgcgcctagggagccggtcggagagcgcgattggggtgcggagccccgacgctgccctgccccggatttcattccgcggcgggggctccgcgagcggaattccggcggctgccgtgactccagtgcaacgtgacgacagcatgtacgatccctgaatgggcccgtgggcatatttagtcattcatttttgatcaggagaaagaagacagccatcatttgaaaggtaaagcttcagcgactgaaggagtgtggactttttgaatttcaagaacagtaaagttggaacacagcagagggtgtgtaataaaatacagattggaaagaagactgatgaagaaaaataacagcatgattcaggcacaccattgagttctttgggatgcccgaaagtgtctggttgggaaacatgaaatagaagacgagaacctgcctcagcaagcgtacctgagaatacttttaaaggaacctgttgataaatgcaaaacagtggctgttgcaggtgatggaactgtactggaacaatgggagaagctggtagcttataggaagccaagatgaccagaatgtttttaaataatccaaggaagaatcctgctcaaaaatgaggtgaattaatacttgggcgctcaggaaccctggacagctacatgaggtgtttaaaaactgccctgaccatcttgccaaacaagtctctgctcatgaggccccacaggatgaacgagccgaggcaggacagtgtcctgccctgtcggaacagtgactgctgacctgccaagagagagctggggactgcctgctgtctgccagtacaatgaaggaagtggtttattggtcacccaagaaggtggcagactggctgctggagaatgctatgccagaatactgtgagcctctggagcatttcacaggccaggacttgatcaacctaacccaagaggatttcaaaaaaccccccttgtgccgagtctcctctgacaatgggcagcggctcctggacatgatagaaaccctgaaaatggagcaccatttggaagcacacaagaacggccatgccaatgggcacctcaacattggcgtagacatccccacccccgacggcagcttcagcatcaagattaaacccaacgggatgccaaatgggtataggaaagagatgataaagatccccatgccagaactggagcgctctcagtaccccatggagtggggcaagacttttctggcctttctttatgcactttcctgtttcgttctcaccacagtgatgatctcggtcgtccacgaacgagtacctcctaaggaggtgcagcctccactaccggacacattttttgaccattttaaccgggtgcagtgggccttttctatttgtgaaattaatggcatgatccttgtaggactctggttaattcagtggctgctcttaaaatacaagtctattattagcagaagatttttctgcatagttggcacgctgtacctgtatcggtgtattacaatgtatgtaactacactcccagtacctggtatgcatttcaactgttctccgaagcttttcggagactgggaagcccaactgcgaagaataatgaagctcattgctggaggtggcttgtctatcactggctctcacaacatgtgtggggactatctgtacagcggccacacggtcatgctaacacttacctacttatttatcaaagagtattcccctcggcgactctggtggtatcactggatttgctggcttctcagcgtagttggaatcttctgtattctcttagcgcatgaccactacactgtggacgtggtggtggcatattacatcaccacgagactcttctggtggtatcacactatggccaatcagcaagtgctaaaggaagcttcccagatgaacctcctggccagggtgtggtggtacaggccatttcagtactttgaaaagaatgtccaaggaattgtacctcgatcttaccattggcctttcccctggccagtagtccacctcagtaggcaagttaaatacagccggctggtgaatgacacataacagctgtacaaagtggggaaaagacaaattgtccgaagtgctaagaactccatgagagaagatgccataaaataaacacctccctaatcctattatctttcaatggttaccttgacttaacctattgagttacctggtcagcactgtgatctttttttctctccaaaggacctgcgttggacaacaataaagaaaaatttaacctatcatgcactgtacacatttcctgttcataagtttgggatttacataacccgcaaccaccatgttcctttgtatatgatgcagcagcataaatgtaagcttttatatcataagttctggtctttccagtcacatctggaaataaagcgtattattttcttgggaaaacatacttttcatatctcttgccccaaagattgggctgtaagccattttctagcaaatgtctctatgaaggtttctaagtacctgaatggggtttgattctgaaatctttctacctgttgcaccgatattcaaataaaaatgatagacacagaaaggtttggtaactttgggttttgtaaaatcagcaaaggcagtgtttcaaaaagtgcaaaaaaaaagattctgttataaagtgattttctaagtatttcctaactttatttttcaaaatgatgttatgaacaccaaatttaaagatttttaacatgtcagagagaagagagttaaaatttaaaaatgcatcttgggagagaaatttgtctatgtttctagtgcctttcttgtcttgattgtatggtcagtaggcaatcttaaatgtttttatttaaaataaagtattccttgaaaatataaatatatgtatacactactaaattttgcatttatagctaaattgaatcagaagactgcttatggttttaaaattgcaatgacttaaataatgaggttgttaattagagtcagagcctgttcacatattgtgatcaggtagcaatgacatgtaccacttaaattattttatcgtcgatttggtagttcaattttaactactcaatgaaaacagccatgaatatcttttcttaaagagagttttgaaaatgatcacttacctaaaacttgaaagctatgaattagttatccatactctcatgacaattttgttggtgaacaacaaaaaagagatctatttctttaaaagatatttgtgcagaaactgcatgtaactctaagttttactcctaacatacatatgtttggggaagtattctattctatacttgccaatgtggagaacaaaatagttttttaagaatgaagaagtatatatatccattctgtattttacgtgcagcagaattatcttccgtaggatttttttgtgtattcacaaggtgatatttgtattgtaaaacaataatggtgaaggaaataaaaaggcttttaaaattttgtttgttttaaatctttgtaaagttattattccagagagtatactggtatcttacagcttacctagatcataaattaatcaaaatgcactttttaataaaaactgatacttaaaataaa

SEQ ID NO: 29824 - DNA, 2198 bp, Homo sapiens
acctacatgtatatatcaaataagtctattattagcagaagatttttctgcatagttggcacgctgtacctgtatcggtgtattacaatgtatgtaactacactcccagtacctggtatgcatttcaactgttctccgaagcttttcggagactgggaagcccaactgcgaagaataatgaagctcattgctggaggtggcttgtctatcactggctctcacaacatgtgtggggactatctgtacagcggccacacggtcatgctaacacttacctacttatttatcaaagagtattcccctcggcgactctggtggtatcactggatttgctggcttctcagcgtagttggaatcttctgtattctcttagcgcatgaccactacactgtggacgtggtggtggcatattacatcaccacgagactcttctggtggtatcacactatggccaatcagcaagtgctaaaggaagcttcccagatgaacctcctggccagggtgtggtggtacaggccatttcagtactttgaaaagaatgtccaaggaattgtacctcgatcttaccattggcctttcccctggccagtagtccacctcagtaggcaagttaaatacagccggctggtgaatgacacataacagctgtacaaagtggggaaaagacaaattgtccgaagtgctaagaactccatgagagaagatgccataaaataaacacctccctaatcctattatctttcaatggttaccttgacttaacctattgagttacctggtcagcactgtgatctttttttctctccaaaggacctgcgttggacaacaataaagaaaaatttaacctatcatgcactgtacacatttcctgttcataagtttgggatttacataacccgcaaccaccatgttcctttgtatatgatgcagcagcataaatgtaagcttttatatcataagttctggtctttccagtcacatctggaaataaagcgtattattttcttgggaaaacatacttttcatatctcttgccccaaagattgggctgtaagccattttctagcaaatgtctctatgaaggtttctaagtacctgaatggggtttgattctgaaatctttctacctgttgcaccgatattcaaataaaaatgatagacacagaaaggtttggtaactttgggttttgtaaaatcagcaaaggcagtgtttcaaaaagtgcaaaaaaaaagattctgttataaagtgattttctaagtatttcctaactttatttttcaaaatgatgttatgaacaccaaatttaaagatttttaacatgtcagagagaagagagttaaaatttaaaaatgcatcttgggagagaaatttgtctatgtttctagtgcctttcttgtcttgattgtatggtcagtaggcaatcttaaatgtttttatttaaaataaagtattccttgaaaatataaatatatgtatacactactaaattttgcatttatagctaaattgaatcagaagactgcttatggttttaaaattgcaatgacttaaataatgaggttgttaattagagtcagagcctgttcacatattgtgatcaggtagcaatgacatgtaccacttaaattattttatcgtcgatttggtagttcaattttaactactcaatgaaaacagccatgaatatcttttcttaaagagagttttgaaaatgatcacttacctaaaacttgaaagctatgaattagttatccatactctcatgacaattttgttggtgaacaacaaaaaagagatctatttctttaaaagatatttgtgcagaaactgcatgtaactctaagttttactcctaacatacatatgtttggggaagtattctattctatacttgccaatgtggagaacaaaatagttttttaagaatgaagaagtatatatatccattctgtattttacgtgcagcagaattatcttccgtaggatttttttgtgtattcacaaggtgatatttgtattgtaaaacaataatggtgaaggaaataaaaaggcttttaaaattttgtttgttttaaatctttgtaaagttattattccagagagtatactggtatcttacagcttacctagatcataaattaatcaaaatgcactttttaataaaaactgatacttaaaataaatggctgttatttct

SEQ ID NO: 29825 - DNA, 735 bp, Homo sapiens
atgggagggcgtggcgggggaggacggtcccgccagctcccaggtcggttccgagcgcccgcggcccgatggccgggcggaagatggctgcccggagcgccgcggacagtcacgtggtctattattagcagaagatttttctgcatagttggcacgctgtacctgtatcggtgtattacaatgtatgtaactacactcccagtacctggtatgcatttcaactgttctccgaagcttttcggagactgggaagcccaactgcgaagaataatgaagctcattgctggaggtggcttgtctatcactggctctcacaacatgtgtggggactatctgtacagcggccacacggtcatgctaacacttacctacttatttatcaaagagtattcccctcggcgactctggtggtatcactggatttgctggcttctcagcgtagttggaatcttctgtattctcttagcgcatgaccactacactgtggacgtggtggtggcatattacatcaccacgagactcttctggtggtatcacactatggccaatcagcaagtgctaaaggaagcttcccagatgaacctcctggccagggtgtggtggtacaggccatttcagtactttgaaaagaatgtccaaggaattgtacctcgatcttaccattggcctttcccctggccagtagtccacctcagtaggcaagttaaatacagccggctggtgaatgacacataa

SEQ ID NO: 29826 - DNA, 1887 bp, Homo sapiens
agctaccttataaagaccatctgtacatccactgtgaaatggagtttcaaaatcacaagcttctttcccacatgaacataagactaggagcacatatggaagagtaaagttgaagggaatttggatgatgatttggcaagatgctgtgggatagtaacatctttttgagggaagaattggcttcctttcttgaaagtggtgaaggtacagcatatagctgcatggaagaaacagtaatcggatggctaccttctacattttgtattaggaaacaaagtccattgtaagagtccatgttgatcttggaaatagaaggattgaaaaaagctaaatttccacaaagaacaagaacttgaccatctcctttttgatctgaagactaggggacaatggatatcatagagacagcaaaacttgaagaacatttggaaaatcaacccagtgatcctacgaacacttatgcaagacccgctgaacctgttgaagaagaaaacaaaaatggcaatggtaaacccaagagcttatccagtgggctgcgaaaaggcaccaaaaagtacccggactatatccaaattgctatgcccactgaatcaaggaacaaatttccactagagtggtggaaaacgggcattgccttcatatatgcagttttcaacctcgtcttgacaaccgtcatgatcacagttgtacatgagagggtccctcccaaggagcttagccctccactcccagacaagttttttgattacattgatagggtgaaatgggcattttctgtatcagaaataaatgggattatattagttggattatggatcacccagtggctgtttctgagatacaagtcaatagtgggacgcagattctgttttattattggaactttatacctgtatcgctgcattacaatgtatgttactactctacctgtgcctggaatgcatttccagtgtgctccaaagctcaatggagactctcaggcaaaagttcaacggattctacgattgatttctggtggtggattgtccataactggatcacatatcttatgtggagacttcctcttcagcggtcacacggttacgctgacactgacttatttgttcatcaaagaatattcgcctcgtcacttctggtggtatcatttaatctgctggctgctgagtgctgccgggatcatctgcattcttgtagcacacgaacactacactatcgatgtgatcattgcttattatatcacaacacgactgttttggtggtaccattcaatggccaatgaaaagaacttgaaggtctcttcacagactaatttcttatctcgagcatggtggttccccatcttttatttttttgagaaaaatgtacaaggctcaattccttgctgcttctcctggccgctgtcttggcctcctggctgcttcaaatcatcatgcaaaaagtattcacgggttcagaagattggtgaagacaatgagaaatcgacctgaggagcaaaacaaaggcatcagctcttacaccaaaagagttaacgctgtaaccaaaggtatagttttgttttttattttaggagaactgactggtaaatgaagaaatggaccaaattttgtgtaaacgattagaaagatgaacaaagtattgccctttgactggttttcttcttcatcctgagaaagatacattctcttgcagctcttcattcattggtgacaagcccccaccccgggactttactaatgagcttgttaaagaggtgccaaagaacatattcctcctttctttattctttctccaccaaaaccctctacttcagaattttttcaggatatttttcagcccaaggtcagaagaatgtgttaatattttaaataaaatatctggacatctaca

SEQ ID NO: 29827 - DNA, 6149 bp, Homo sapiens
agattgatctctgttgccgctcagggaggtcagctccaggccctcagcctttcggccgggagccaaactgccctgcctgccaagcccctccttctctgcaccttaaacagccgcgaggggagagtcggctgggattttcttcttaagaagtcgcgcaggtttttcgagctccactctgcgccaggagagccacggcagcaggaacgggcactgctgccaccgggccgacggagctgcatcctgtggccctataacactcttctccaaaaggacctgccagagactgggagtgttgactgctgcaaggaccaaggtgggatagtaacatctttttgagggaagaattggcttcctttcttgaaagtggtgaaggtacagcatatagctgcatggaagaaacagtaatcggatggctaccttctacattttgtattaggaaacaaagtccattgtaagagtccatgttgatcttggaaatagaaggattgaaaaaagctaaatttccacaaagaacaagaacttgaccatctcctttttgatctgaagactaggggacaatggatatcatagagacagcaaaacttgaagaacatttggaaaatcaacccagtgatcctacgaacacttatgcaagacccgctgaacctgttgaagaagaaaacaaaaatggcaatggtaaacccaagagcttatccagtgggctgcgaaaaggcaccaaaaagtacccggactatatccaaattgctatgcccactgaatcaaggaacaaatttccactagagtggtggaaaacgggcattgccttcatatatgcagttttcaacctcgtcttgacaaccgtcatgatcacagttgtacatgagagggtccctcccaaggagcttagccctccactcccagacaagttttttgattacattgatagggtgaaatgggcattttctgtatcagaaataaatgggattatattagttggattatggatcacccagtggctgtttctgagatacaagtcaatagtgggacgcagattctgttttattattggaactttatacctgtatcgctgcattacaatgtatgttactactctacctgtgcctggaatgcatttccagtgtgctccaaagctcaatggagactctcaggcaaaagttcaacggattctacgattgatttctggtggtggattgtccataactggatcacatatcttatgtggagacttcctcttcagcggtcacacggttacgctgacactgacttatttgttcatcaaagaatattcgcctcgtcacttctggtggtatcatttaatctgctggctgctgagtgctgccgggatcatctgcattcttgtagcacacgaacactacactatcgatgtgatcattgcttattatatcacaacacgactgttttggtggtaccattcaatggccaatgaaaagaacttgaaggtctcttcacagactaatttcttatctcgagcatggtggttccccatcttttatttttttgagaaaaatgtacaaggctcaattccttgctgcttctcctggccgctgtcttggcctcctggctgcttcaaatcatcatgcaaaaagtattcacgggttcagaagattggtgaagacaatgagaaatcgacctgaggagcaaaacaaaggcatcagctcttacaccaaaagagttaacgctgtaaccaaaggtatagttttgttttttattttaggagaactgactggtaaatgaagaaatggaccaaattttgtgtaaacgattagaaagatgaacaaagtattgccctttgactggttttcttcttcatcctgagaaagatacattctcttgcagctcttcattcattggtgacaagcccccaccccgggactttactaatgagcttgttaaagaggtgccaaagaacatattcctcctttctttattctttctccaccaaaaccctctacttcagaattttttcaggatatttttcagcccaaggtcagaagaatgtgttaatattttaaataaaatatctggacatctacagccactgtgtaaatagaactgcctaatgttgagagtggtttttagcattaggtttagcaagggggagatccgtgggttgtgcgtcagctttgggtgaattttgtttctaccctgtcacggggaaagttcgggttgagtccaggagtgcacactgctgctgccacccaatgcgctacatatcacttttttttgttttgttttgttttgtttttaaaagatcattttatcttaaaaaggaaagctgatccaagtaaacacgaaagtatttgacacaccccacagattttacatgtgtgtaaatgtttcactttaaaatctctatgacagatacacaggaaacatgagatggtttctgctaatgagtggcccttgagtacacacttagatgctgtctgccctgtaaatttggatctggtgccccagggcagtcaactcttctagcacaggctgaaaacacgtgtgtgtcaactgaggttcacaccacttggggaatgagcctgttttctttccaggtcaggccctggtgtgagatcaattttagggctcctaattggagcacagaaatgtatttggtcaaatttcattgaaggtgatttcttcctttttctgttgtactttatggaaaaaccaagatggaacctgaaagttaatgtatccttgcttttagcaagagactcagtttcttataactagtcctaaggacatatgccgcaattgagtaattttacttttaccctatgaaaataacatggtgctgcactataatatactctcggaatcagtgtgttagttacagctatacagtgaagggggataactgtttctaaatttctttaaggtgatgccaaaaaatggattaaaaaatctgatcagatttaatgttaccagatttagtgcattatttaatgctattggatcttttggataattcttggcttaatttcttagctacttgaaggttaatttgcaagacttttaaaaccttagaaaagttttaaggttgcaaagttatcaacactggggcagagggtggagaggccaatgcgggtagaaggaggcagttatgtttatattgaaggtgaaatttttctttcatttagaatggaaaacatccccaaatgtatcattataaactagtcagccttgactacacaaaattgacctttaagttgcttgagaaaaacacaatgcaaatcgttcagaagggtcaacatcctttggtgctaaaatcttgtgtatgttttcagaatggctttttctgtatgttatagaataatcactaaaggaaaggtagttgaatttaaagtcatgaagcaagactctttaattcagttattttaaacaagaattaaaaccccaaacatccttggcaggctttgaagcacacagaattttctagtatttcttattaaatacaccaataataaacatatacttagtttacctgatgagtttagacataattctatataatgttcgcttatattcatttattaactagcaacacttgtgcaagaacaaggtattctgcttgaaaacactgatttttaagttcctgttgcccgattgtaaagaaaatcatctgacacagaagcctggattttgctctcctaacactggtgttttccttgagcctctaattcaaataaaacaaactgatacaccttacagccttattcatctgtgtctggataactcacttttcatctattgaataagaaaaagtgtttaaacttaataaaataaaaaattgtgcaccaattactacagatccttgaaacagtaagccttggattttagtcaagtaatccagtttttttttaatttaaaaaaaaccatcaccttttaaagaactttaaaaacacctgtgatgccaatgtggacattgccgctgccatgtctttacacgcatgtgtcgtatagctctgtcatcgagttgaggaagtccatggtttgcaaataagggtgggggaatcaaaatttcaagatggaaaaataaaacaaatagtaaaacccatttacatgtaggaaagaaaagttgagcttcaacccaatgtgccactttgatataaaacaagtatgatatatatataaactgaagatataaaacaagtatgatcttgcctttgaaatcataaatgtttggggtacctgttctttgccagttaagatacatatcttattatctttgtttttttcaagtctatgctcctgtttgaagcttttcctgtaatttaggttgtctgtgaaatacctataacatataattcctatagagtatgccacattttttttctaactcatttcaaatgaaattctctcagattctagtttttgagcttgtccactagatctgaaaataaagcatcctttcctgagtccacttgaactaattgtgaatttgttacttaatttactggcatcttgggaaacaagttttgctgtggcaggaaggctgttttgagagtgagcgttgagtctactctggtttgtggatgacattgcattagggttatttcctgtattaccagtgcccccttgtggcaatatactttatgacttggaatgcaaacaccacttttaaaagcctgttttcaagtttttgaaaggcatttgttttctgttgtttgccaataatctgaaagtatcatgtgaaaggaattattttaaaagcattttaaacctttcccaaaggtaaaatgtgctcagattataggcacttgtaattctaaccttgtatccatttgatcaaagaaaatttgtagaacatttttacctctcatgatcacaatcattagtgtctccctttataacgacctatgttttgtttactttgaaacaccaaatttgttgtcttggttttttttacatgacagaactcatgcagtttcttttttagttgaaagttcacatcttgccccttgaatagtttgaacatttctttcttaattcttttttgtttttgttttgcactgtaaaactgatgaaaactttaagccaatcttaatgcactagcctctgtagtgtaaggaagtgtgagaaggagtttcttaatgagtttacacgtttaaatcaagcatattataagttatatgccatgtgttgaaggcttttctatttatatatataaagatttttagtatttgtttttagtgtccttgtgttgcaataatttaactcctttgactcagttgctgaaaatatttcttctattaagaagtgctcttgacttcaacacccaaacactgaaaatcatgtcaatgttacccaaagataagtttttatacagatacacaccttataagttctgatttattttcttactcattatgctgtgttctaaataaatcatgaatgagaagagtgctttattgtgaaattatttaaaactgtcctttaaaagaaaaagaggaaacgatgaacaaaaactaatctaattgccaagttagaattcattatttaatttacctcctatgcaatgattaatgctgcaaaatgtatggttatgttaccgtatattcacaaaagaaatattattacaaggtttcagaggtagccaattgcattcttttggaaatttactgtactgtttcaatgtgttaagtgccttgttgtaaagtaaaattttaagtctagattcattattttcctgacatatatttttcattatgatatctactgtatgctattgtgatagttttatgaaatgcttacattttaatcaaatatgtaaatttcagaagctcttttttcctacccaccagtaccttaatcattggtttatcacattggattcaaattcaggttccttttttgataaagaggaaatttgttttccatgcttgtgattttgtgtttgtaaacatttcaggaggaatttaggagtgtaactatagtttatacttctataatgttgtcttacatttacatttttaagtgcctaattgttaaaactgatttatgtttctcttctaaagaggatatgtgtacttggtttctaatctctttggttttgctttttaaaaaatgcaagagcctatactttgtatttacctaataaaccacagtgacatcaacagtcttttcaaaattaa

SEQ ID NO: 29828 - DNA, 2127 bp, Homo sapiens
aaatggagtttcaaaatcacaagcttctttcccacatgaacataagactaggagcacatatggaagagtaaagttgaagggaatttggatgatgatttggcaagatgctgtaagtggattaggcaaggctgctaaagagagacaggaaatggctgtgttagtgcttcggacctccgttagaagtagcagttcatggtgttgaaggtttgttgttgaaaataccttcctgaggcacctcttcattgtgcttattcttcccacaacattgtgccaagacactgtcaagcctgggcctgtcaaagcctgggatgtcaaaggcctgggtctttctcatcctgctgtaatgtattgatagctgggggctctgcagaaggacaagggaaaggtgggatagtaacatctttttgagggaagaattggcttcctttcttgaaagtggtgaaggtacagcatatagctgcatggaagaaacagtaatcggatggctaccttctacattttgtattaggaaacaaagtccattgtaagagtccatgttgatcttggaaatagaaggattgaaaaaagctaaatttccacaaagaacaagaacttgaccatctcctttttgatctgaagactaggggacaatggatatcatagagacagcaaaacttgaagaacatttggaaaatcaacccagtgatcctacgaacacttatgcaagacccgctgaacctgttgaagaagaaaacaaaaatggcaatggtaaacccaagagcttatccagtgggctgcgaaaaggcaccaaaaagtacccggactatatccaaattgctatgcccactgaatcaaggaacaaatttccactagagtggtggaaaacgggcattgccttcatatatgcagttttcaacctcgtcttgacaaccgtcatgatcacagttgtacatgagagggtccctcccaaggagcttagccctccactcccagacaagttttttgattacattgatagggtgaaatgggcattttctgtatcagaaataaatgggattatattagttggattatggatcacccagtggctgtttctgagatacaagtcaatagtgggacgcagattctgttttattattggaactttatacctgtatcgctgcattacaatgtatgttactactctacctgtgcctggaatgcatttccagtgtgctccaaagctcaatggagactctcaggcaaaagttcaacggattctacgattgatttctggtggtggattgtccataactggatcacatatcttatgtggagacttcctcttcagcggtcacacggttacgctgacactgacttatttgttcatcaaagaatattcgcctcgtcacttctggtggtatcatttaatctgctggctgctgagtgctgccgggatcatctgcattcttgtagcacacgaacactacactatcgatgtgatcattgcttattatatcacaacacgactgttttggtggtaccattcaatggccaatgaaaagaacttgaaggtctcttcacagactaatttcttatctcgagcatggtggttccccatcttttatttttttgagaaaaatgtacaaggctcaattccttgctgcttctcctggccgctgtcttggcctcctggctgcttcaaatcatcatgcaaaaagtattcacgggttcagaagattggtgaagacaatgagaaatcgacctgaggagcaaaacaaaggcatcagctcttacaccaaaagagttaacgctgtaaccaaaggtatagttttgttttttattttaggagaactgactggtaaatgaagaaatggaccaaattttgtgtaaacgattagaaagatgaacaaagtattgccctttgactggttttcttcttcatcctgagaaagatacattctcttgcagctcttcattcattggtgacaagcccccaccccgggactttactaatgagcttgttaaagaggtgccaaagaacatattcctcctttctttattctttctccaccaaaaccctctacttcagaattttttcaggatatttttcagcccaaggtcagaagaatgtgttaatattttaaataaaatatctggacatctaca

SEQ ID NO: 29829 - DNA, 581 bp, Homo sapiens
gagcagtgtatccagggagaggactaattacgaggtttgaaaacctcatcaggtggctggtttctgtagcaggactaaaagactgctctcctaaattgagaacagctggggctgtgtgctagcaagtataaaagaggtggcagtggtgccccgtgtccgaaagaagtgtgtgctctctggagcctgtggagctgaagccaaaggtgggatagtaacatctttttgagggaagaattggcttcctttcttgaaagtggtgaaggtacagcatatagctgcatggaagaaacagtaatcggatggctaccttctacattttgtattaggaaacaaagtccattgtaagagtccatgttgatcttggaaatagaaggattgaaaaaagctaaatttccacaaagaacaagaacttgaccatctcctttttgatctgaagactaggggacaatggatatcatagagacagcaaaacttgaagaacatttggaaaatcaacccagtgatcctacgaacacttatgcaagacccgctgaacctgttgaagaagaaaacaaaaatggcaatggtaaacccaagagctt

SEQ ID NO: 29830 - DNA, 570 bp, Homo sapiens
atctgtacatccactgtgaaatggagtttcaaaatcacaagcttctttcccacatgaacataagactaggagcacatatggaagagtaaagttgaagggaatttggatgatgatttggcaagatgctgtaagtggattaggcaaggctgctaaagagagacaggaaatggctgtgttagtgcttcggacctccgttagaagtagcagttcatggtgttgaaggtgggatagtaacatctttttgagggaagaattggcttcctttcttgaaagtggtgaaggtacagcatatagctgcatggaagaaacagtaatcggatggctaccttctacattttgtattaggaaacaaagtccattgtaagagtccatgttgatcttggaaatagaaggattgaaaaaagctaaatttccacaaagaacaagaacttgaccatctcctttttgatctgaagactaggggacaatggatatcatagagacagcaaaacttgaagaacatttggaaaatcaacccagtgatcctacgaacacttatgcaagacccgctgaacctgttgaagaagaaaa

SEQ ID NO: 29831 - DNA, 3312 bp, Homo sapiens
agcgctgtgccggttccgctgccgctggccaggagcgcggggacagttcggggctgcgccggaggccggcccgccttcccgggggttccgttatcatgtcgctgaggcagcgcctggcccagctggttggccgtctgcaggacccgcagaaagtggcccgtttccagcggctgtgcggggtggaagcgccgccgcgccgctcagcagaccggagggaggatgagaaagcggaggcgcctctcgccggagaccctcgactgcgagggcggcagccaggggcgcctggaggcccccagcctcccgggagcgaccgcaatcagtgcccggccaagccggacggcggcggcgcccccaacggcgtgcggaacgggctggcggccgagctgggcccggcctcgccgcggcgcgcgggcgctctgcgccgcaactcgctgacgggcgaggagggccagctggcccgcgtgagcaactggccgctctactgcctgttctgcttcggcacggagctgggcaacgaactcttctacatcctgttcttccccttctggatctggaacctggaccctctggtgggccggaggctcgtggtcatctgggtgctggtcatgtacctgggccagtgcaccaaggacatcatccgctggccgaggcccgcctcgccgcccgtggtcaagttggaggtcttctacaactctgagtacagcatgccctccacccatgccatgtccggcaccgccatccccatttctatggtcctcctcacctatggccgctggcagtaccctcttatatatggactgattcttattccctgctggtgttctctagtttgcctaagtagaatttacatgggaatgcactctattctggatattattgctggattcctatataccattttaatcttagctgtcttctatccatttgtggacctgattgacaacttcaaccaaactcacaaatatgctccattcatcatcatcgggcttcatttagctttggggatcttttctttcactcttgacacctggagcacatcccgaggagacacagccgagatactaggaagtggtgctggaattgcatgtggatctcatgttacttataacatgggtctagtattagatccttctctagatacattacctttagctgggccccccattactgtgactctgtttggaaaagccatattgcggatcctcatagggatggtatttgtactaataatcagagatgtaatgaaaaagatcaccattcctttagcctgcaaaatcttcaatataccgtgtgatgatattcgaaaagcaagacagcacatggaagttgaacttccttatcggtatattacctatggaatggttggtttctccatcacattttttgttccttacatatttttctttattggtatctcttgatggagaagtattgtttatgataagaaaggagggtatcagttactgatacccaaaaatatattccaggtaaagccaggtcagaattaggcttttgcaggaatttaacttaaataattatttaagtaaattcataagagtcagtgcattttatcattgcacatccagatactgttttaggtgagctgagctatttcgttactgagaaaatgataagtatccatttagaatgttcatgtaatgtttggagagttttgtattatggattcaacttatatataatatatataaggtacataatatgcaattatatatctgatatatattatatataaaataatatacctaagtgtttttttaaactatgggagtgtattataaaatcaataataatatgcaaacagttgtgcctgtgtatttgaactacatacaggtatgttgttattaacagatatatttaacatttatttactatgggagccatttcctaattgaattgcgtaattactagaccagaatgcatatgctactatacattgatttactgcctgtttttacactgccattacctttcatgttatccatgatgttgaacatgggaggcatttttaatggaccaaatttttagaaaaattagtttttggatttttttttaagttctgtatactgttttgaatgaactttatttgcagctattctggatgtcagtttaataattcaggtactgaattttattgcttgctaattgtgcctttccgttgctaaattaagaaatgctatgtgtactgtgatgtaaaaataagacattaactttatcttaagttacatataatcaagcaaatattttaaaaaatgtatgtcagggtgacaggcataaaagtaaattacccttaactctttagcctttatttagaaagaaatgtggaatgggctaaactttctcaccaatttattagaaagctaaatggataaatacttccctttttgtagatatttttctgtgcattgtaagttataggagcaggacatattttttgtacattgtcttgattgtttatactgcaggtaggtatttccagtgaatggaaacgttgaaatttatagatgggacaatgcacatacttcatatgtaaacaaagcatttttctaaataatttggaaaggattggatttagcaccgttaacttttaatacccatttattggctatttaaggtaaattataaaacctaaaattagtatcagtattttagatcctattattttttcaactttctattattttcacagtggaaaatttgcgtatagtattaaactattcttttttctgtctacctttatattttgaagtgtggttgtacttacgttaatagtaagtgtatttgtagaaagtttttcataaagaagagattaactttccatataaataaataccaggtatgaaattactgattttagtgcaatatctgtatgattatccagaactatcacttcagatgtttctattttgggcaccataactatttgagctcatatttttataattctgattgagaatttaggggcatggtaatttttaccaaaactgaagctggtaattttaagtaaagcaactaaatttaccctttacttattagttaaaaggaaaccaaggcatgtaggaaaatattggtacgttggaaaatgtgaaaagagctttactttcaaaatgtatgtttaatgaattgaattttagggaccgtttcccataatttgggcctatgctatcctgttgatttttatgtctagcttaaaaggtatttgaaaatgttccatttgtgttttattattttctgtcctatgacagttctatgctaaatgtattttaaaataaaagccaaattgaagattaaaga

SEQ ID NO: 29832 - DNA, 3336 bp, Homo sapiens
ggcgggggcgaggcgggagtggcggtgccagcggagggcaccggcccggcgtggcagcggcggcggagcgcggccccgggcacaccatggccgagctgctgcggagcctgcaggattcccagctcgtcgcccgcttccagcgccgctgcgggctcttccccgctccggatgaaggcccccgggagaacggcgcggaccccacggagcgcgcggcgcgggtccccggggtcgagcatctccccgcagccaacggcaagggcggcgaggctccggccaacgggctgcgcagagccgcggcgccggaggcttatgtacagaagtacgtcgtgaagaattatttctactattacctattccaattttcagctgctttgggccaagaagtgttctacatcacgtttcttccattcactcactggaatattgacccttatttatccagaagattgatcatcatatgggttttggtgatgtatattggccaagtggccaaggatgtcttgaagtggccccgtccctcctcccctccagttgtaaaactggaaaagagactgatcgctgaatatggaatgccatccacccacgccatggcggccactgccattgccttcaccctccttatctctactatggacagataccagtatccatttgtgttgggactggtgatggccgtggtgttttccaccttggtgtgtctcagcaggctctacactgggatgcatacggtcctggatgtgctgggtggcgtcctgatcaccgcactcctcatcgtcctcacctaccctgcctggaccttcatcgactgcctggactcggccagccccctcttccccgtgtgtgtcatagttgtgccattcttcctgtgttacaattaccctgtttctgattactacagcccaacccgggcggacaccaccaccattctggctgccggggctggagtgaccataggattctggatcaaccatttcttccagcttgtatccaagcccgctgaatctctccctgttattcagaacatcccaccactcaccacctacatgttagttttgggtctgaccaaatttgcagtgggaattgtgttgatcctcttggttcgtcagcttgtacaaaatctctcactgcaagtattatactcatggttcaaggtggtcaccaggaacaaggaggccaggcggagactggagattgaagtgccttacaagtttgttacctacacatctgttggcatctgcgctacaacctttgtgccgatgcttcacaggtttctgggattaccctgagtctcaaacagttggaaactagcccactggacatgaaagccaagacataggaaagttattggtaggcaaatcttgacaacttatttttctttaacaacaacaaaaagtcatacggctgtcttgctactaccagataaatgatgctgctgtgtgaaaggaagaactgtctcatagcggtcattggtcgtccgtggtggttggttgtgctacagttgaacccaggctaaagaccataatccggatctttaaaggcacacaccgcgccccccccccccccgcccggcccctgctcctctcgctgttgcacgggctttggatctagtcatgggctggcaggaattgtggcctggcttaggaatagctatgagccccactgggttctggagagccagtagagatggggtgatctgggaggctggaggtagagcctttcttttccgttacaaccttgcctagcatggagttatttctaaaatgggaactttggtctaggagaaggggtggcaccatatgaaacggcattccttggacagggtgacttccttatcgtttatttggtgattttttgttttgttttgtttgagacaggatcttgctctgtttcccaggctgtattacagtggcacaatctcagctcactgcaaactctgcctcccgggctcaagcaatcctcctgcctgagccaactgagtagctgggactgtaagcatagaccaccatgtgcccagctaatttttgtagagacagggtttctccatgttgcccaggtacgtctgaaactcctgggcttaagtgatccacccacctcagcctcccaaagtgctgggattataggcatgagccactgtgcccggcctcctccttgttatgatcaaattagactgtgcctggttgggtggtaagatcactctgaaagaaagctcactgtgaagagatgaaaggtggaggcagagctgtgaggtcatggggaaaagcctgctttccttataagtcctgctgttcatgttggaataaggatctgctcttccttgtttccatgcattttgcaggattccaggtaccattaccacactcttctgacccatgaaaccaactggctgctcacacatcaccaaacaggttgggggttagccttcagcacaggtggatacatctgggattcactgagattcctgccctctcctgcttcctagtggtttgggacaggccctctgcccatcgtcagcagttttttgctttcatacaaacctggaaggcactggcatctgcctaggaaagtggatctgtgaagaacagatgaactcaatcctttctggagtctgacaaagaagggataggcttccttgacattgcctgtcctgacaaggcctccctgacattactcctccaatttcacagttaccttctgtaaatctattttctcatctactgaatagaatcaggcgccctttttgtcttcccacctcttatctcttggcaattttaaggggaattaatgcaagaacaactttagtgtctcttgggaaaacaagccaaccaaatacaaaacccattaagcctactagggtgagtcctcttaacatgggaaggcgatgattatgcaaacaccggagttccctcctcttcagttcctaagaataaagaacaggtatcaagaactttctttaaagttagtgtaactatagttaacaaagtatccattgaagtttagtgcctgtaggactgagccagtgctttatcaacccaacacatcatcaccatgtgcatactctagaaaaaaaaatagcttccttaaaagttacagaggctcttaacgtgttaaaaccgaaaaatcacatttttcttgatttcaaatatgttctacggccttactgttgggatgatatttagtatgtaacttagcattccaatttctcaagaatttttaggccgggtgcggtggctcatgcctgtaatcccagcactttgggaggccgaggtgggcggaccacgaggtcaggagatcgagaccatcctggctaacacggtaccccgtctctactgaaaatac

SEQ ID NO: 29833 - DNA, 3584 bp, Homo sapiens
cggccgccctggggacgcagacgccaaggcccctccggccagggccgggagccgggccggcctagccagttctgaaagccccatggccccagcaggcctctgagccccaccatgggcagcttgtactcggagtacctgaaccccaacaaggtccaggaacactataattataccaaggagacgctggaaacgcaggagacgacctcccgccaggtggcctcggccttcatcgtcatcctctgttgcgccattgtggtggaaaaccttctggtgctcattgcggtggcccgaaacagcaagttccactcggcaatgtacctgtttctgggcaacctggccgcctccgatctactggcaggcgtggccttcgtagccaataccttgctctctggctctgtcacgctgaggctgacgcctgtgcagtggtttgcccgggagggctctgccttcatcacgctctcggcctctgtcttcagcctcctggccatcgccattgagcgccacgtggccattgccaaggtcaagctgtatggcagcgacaagagctgccgcatgcttctgctcatcggggcctcgtggctcatctcgctggtcctcggtggcctgcccatccttggctggaactgcctgggccacctcgaggcctgctccactgtcctgcctctctacgccaagcattatgtgctgtgcgtggtgaccatcttctccatcatcctgttggccatcgtggccctgtacgtgcgcatctactgcgtggtccgctcaagccacgctgacatggccgccccgcagacgctagccctgctcaagacggtcaccatcgtgctaggcgtctttatcgtctgctggctgcccgccttcagcatcctccttctggactatgcctgtcccgtccactcctgcccgatcctctacaaagcccactactttttcgccgtctccaccctgaattccctgctcaaccccgtcatctacacgtggcgcagccgggacctgcggcgggaggtgcttcggccgctgcagtgctggaggccgggggtgggggtgcaaggacggaggcggggcgggaccccgggccaccacctcctgccactccgcagctccagctccctggagaggggcatgcacatgcccacgtcacccacgtttctggagggcaacacggtggtctgagggtgggggtggaccaacaaccaggccagggcagaggggttcatggagaggccactgggtgaccccagatagagacttggggctactgagccagatgcccccgccccacagacctgggtgatgttgcaaatatttcacacctggaaaggccagataaggcactgactagtcacatagcagtgttgcagtgcggtcctgagggccagtccagtggctagtgtgacccctttagaactggatcctggggaggccagggcaggggacctgtgaagagccagggtgagggcaggcagcatttaaggggagctcagggcaggagcactttaccacctggtacaaaggatttttttttttttttgagacggaatcttgcactgctgcccaggctggagtgcagtggcgtgatctcggctcaccgcaagctccgcctcctgggttcatgtcgttctcctgcctcagcctcccaagtagctgggactataggcgcctgccaccacacctggctaattttttgtacctttagtagagatggggtttcaccgtgttagccaggatggtcttgatctcctgacctcgtgatccgcccgcctcggcctcccaaagtgctgggattacaggcgtgagccaccgtgcccggctttttttttttttttttttttttttttttttttttttgagatgaagtctcgctctgttgcccaggctggagagtgcagtggtacggtctcagctcactgcaacctccacctcccaggttcaagcgattctccagcctgagcctcctgagtagctgggattacaggtgcctaccaccacgcccaggtaattttttttttttttgtatttttagtagagacggggtttcaccatgttggccaggctggtctcgaactcctgacctcatgatccgcccgtgttggcctcccaaagtgtgggattacaggcgtaagccacctcacctggcggtacaaagaatttctgcattttcttccctggcccctagtcctgcaccgatttctccttttcgaatgtattcctcctgccaccttctctgggcaacttcgtgcgactacagaaccactgtcctgaggagctagaggcctcctctctgaccatccagagcccaaatccacagcttccccaaatttcatcagctgccacttgacgacttctccccgtctctctgaggcccggaaaccacggctggaggtggggaggggatggcggctgaggtccattcctcattctcagacctcattgctcagttgcactatttggggcacagaataatcaccaaaagtgagaaaaacgagtttgggtggctggggaggactttgggactcttgatgcaaggcgcaacttgagaaaattctgggtgtgatatttgcacagacaccctcctttcaaaaacagccaccccccaagctattctcagctccacacctgcagccccagctaaggtaccaggtctcctgagcaaggcagagagaagccttgagccttctctgtgtcttctttcaagaaccccgctgtgtcttctttcaagattttttttttgagacagtttcaagatttttgttttgtttttgagatggagtctcactgtgtcacccaggctgaggtggcagtggttcaatctccgttcactgccacctccacctcccgggttcaagcgattctcctgcttcagcctctcgagtagctgggactacaggcacctgccaccatgtctggctaatttttgtatttttagtagagacagggtttcactacgttggccaggctggtctcaaactcctgacctcaagtgatccgcccgcctcggcctccccaattgctgggattacaggcgtgagccactgtgcccggccttcttctttcaagttatatagaatggagcatgggggtggcagtggctagggacatttcctggggacactctcccctaaccccccagaaggacttcacaaaaacctgtggataatggaagggatgttacggtacaaacgtatatttatgtgtgtgtgtgtgtatgtgtgtgcgcgcgcgcgtgtgcacataggcgtgatgtctgtgaccctcctctcctcgtcacatttcccccagaatgaatgctgtcctgtctgctcatgtttgtgttgaagctgccaaagtcggggagctctggtcctgcccagacccctttggaattgctggcccatcctcccactggagagctggggtgcagctcaccttggggaaggaaacctcatgcctcagagtaatttcttgtgaatgcaaagcctgggggagcgggtctttggggggcaaggagccagtcaggggcttgtttcccctcatagagctccccagacgtgcctccgcaatgcctgaaacccagacctaggctaataaacggttcaatttctgtt

SEQ ID NO: 29834 - DNA, 4206 bp, Homo sapiens
tagtctctgactcgctcgggcagaggccgaggaagccggttccggggacgggcaacagggactcagggaccagaaggcggctgcaggacgcgaccgagcaggaccccaggcccgggaacgacgtcgcgagcgctgagactgccgggcctcccagcccatctggcattcgagcgcaggaccgggcgccccggcaccgccgcgcgccacccgctaggatgccggtggccccagcgccctcagccgacggaggagccctttttcaacgccctcgctggagtctggcctgcacgccttgctgaatgaagccggaacctcagccccgcttccctttgaaatgaatgttcctggggcgccctctcgtggattttggagctaatcgtctgtgaatgccaagtgatggcaactgccctcccgccgcgtctccagccggtgcgggggaacgagaccctgcgggagcattaccagtacgtggggaagttggcgggcaggctgaaggaggcctccgagggcagcacgctcaccaccgtgctcttcttggtcatctgcagcttcatcgtcttggagaacctgatggttttgattgccatctggaaaaacaataaatttcacaaccgcatgtactttttcattggcaacctggctctctgcgacctgctggccggcatcgcttacaaggtcaacattctgatgtctggcaagaagacgttcagcctgtctcccacggtctggttcctcagggagggcagtatgttcgtggcccttggggcgtccacctgcagcttactggccatcgccatcgagcggcacttgacaatgatcaaaatgaggccttacgacgccaacaagaggcaccgcgtcttcctcctgatcgggatgtgctggctcattgccttcacgctgggcgccctgcccattctgggctggaactgcctgcacaatctccctgactgctctaccatcctgcccctctactccaagaagtacattgccttctgcatcagcatcttcacggccatcctggtgaccatcgtgatcctctacgcacgcatctacttcctggtgaagtccagcagccgtaaggtggccaaccacaacaactcggagcggtccatggcactgctgcggaccgtggtgattgtggtgagcgtgttcatcgcctgctggtccccactcttcatcctcttcctcattgatgtggcctgcagggtgcaggcgtgccccatcctcttcaaggctcagtggttcatcgtgttggctgtgctcaactccgccatgaacccggtcatctacacgctggccagcaaggagatgcggcgggccttcttccgtctggtctgcaactgcctggtcaggggacggggggcccgcgcctcacccatccagcctgcgctcgacccaagcagaagtaaatcaagcagcagcaacaatagcagccactctccgaaggtcaaggaagacctgccccacacagccccctcatcctgcatcatggacaagaacgcagcacttcagaatgggatcttctgcaactgatcgtctccatgcgccctgctctgcggctgtgttcttatttattgcatgcgtcgcttccacaggggcccctcaagagctgtgactcgggagagctaccttactttgaccaacagcctgcccagtgtggatgtctcttacagagggggcccaaggaatcaccaccccgcttcagtgtaaacaacgtgccttgtccactttgggctccagagtctttcagatgtactaagctgctgacatcatccactgccttctgctgcatcctagacaccctccctgttgttcacagagagggaaggtcgtgggccacacaatgctgtgtgaccctctccgtgtgcctctgaatggtgttttgatgattttacactacatttcctgtgcgtagaatggatgcttgtatattcgtacatctctatgttacacagaatttgtgttgcaggtgtttgccatgtggtacctacatagaatctccatacaacacacaggtaacaggttatacaagtggattcagactgaacccccagtacaaggacattgttttgaactaggtggacatgccatccctggtctccttagactgacatgattctcatgttaaccaagttttaaaagttcaaattccccaaaaaggcttgtccaaggctggccccagatgtgtgggtctgacccacaccagccctgtgtcctgtcctttcagtcatttgtccctgcgtaattttaatcgtattccaaagcccaattatgtgatggttttcaggtttctgcaaattacagaagagccagccaagatcacccaggagcttgtgcccccagatgggccaaagaaagagcctatgaaggagaagcagaagcagacggctggcctggctcaccttcccacgccagtggggcaggggtctgcttcaggaaatggaagctgtccaggaaatgagcagagattcacaagacagcactttgattctatgttgagtttgtttctatattagaaaagcagcaagtcagtaatcccccgtggcatcacagctaagtagctgtggccaccggcagtttcacagcatcctgaaagctggcactgatcgtgactatcagtgaaagaagtttaattttcaggttagaaaatgtgatctggcagtttatgcattcttcagagtaatgtaataatacctatgtgatgctgtaattttacttttcaacataagttgaacccgtagcagtctgtttaccttgtaaagggattacttagaagacatttttgtacatgctcttccccaaggattgtacgtattatacaaatagatggaaagaaaagtgaacacgtttgtagaactttcataagcacacagttgctgtgttgagttctctttaaaaacaaggacaaaaccaaccagcgttcaaaggaacctcccatcagagtcccctaaagtattttaggttcagtgagcatttgcctgaataaaacctaaaagagtagtcttaacacattactaactttttctaagagaaattgattcctgttttgtcatctgatgcaatttgctcttataaagagacattttcataggttcagagtaactcacctccatgggctgaccaaaggcttttctaatttttgttactgatgagatgaaacctatttgtaaggagatcttccccaggagcatttctgttgccttcttgacatcaatgaaaagtagcatattctcttatgaaatagcatgagaaaacacagggcatttctaggacagtaaaacgttaaagtactggattaagaaaacaacaacaggctgggcgcagtggctcacacctgtaatcccagcactttgggaggctgaggcgggtggatcacctgaggtcaggagtttgtgaccagcctggccaacatagtgaaatcctgtttctactaaaaatacaaaaattagctggatgcgatagcacgtgcctgtagtcccagctactcgggaggctgaggctggagagttgctcaaacccgggaggcggagattgcagtgagccaagatcgcaccgctgcactccagcctgggtgacagagcgaccctctgtctcaaaaaataataataataataaataaaacaacaacaaaatgcatcagagagccaaaacattcagtattgcattttcacataggtgatgaaatgactttggaactttatctgtgttatagttatgagttgctttgggagacttggagctctctgtagctattgttcataacactttgctccataaccctgatgtccgcagtatctaagtatctcagccttcatccattaactctactagggagcccacagccaccatttccactaggaggtatcaatatttgtggtatgacataaggctcccttgaaataacaagacttttgagcaatctgaattaaaaatacatcaaaaaagtaatagcgctcatttgctaaatgcaaaaaataatcacctttgataccaatgtgcaccaatatgcctaactagctagccagctggagataatttaccagggaatgtttcaaagccctaaccttgaagtttggaaacaggtggtcttctatgctgcagagaaactatgcattaggtctcttttcaattagaaacctttactatttccaatgtatgtttgttaaaaataataataataaaaccaaaagcctttgtggaaaccca

SEQ ID NO: 29835 - DNA, 8505 bp, Homo sapiens
catggggagaggaaagcaatggacacaattgtatcctgtagggtttcattcacgtgaaggtcagaagcaggctaaactcacctaggggagagtcctatcccaggtagtggtcatgcttggggacaggtggtgactaggaggggcacaaggaaggctgcagggtccggcccatcttgttgctggcctgggtgctggtctcactgatctctgtgtggtggggcaggtcagcctcccaggcctgctggtgcctgcagtgcccagcactcctgccgtgcctggcagtgttagtaccaatccgccagagtgactgactcccctcttgccctgagtagggcttgctgactccaggagcctcagggcggggtgggctttgagctttcttctagcaaacttgaggtctgtggctggtacccctcaggagcggaggggaactcttgtccatgagatgcttttaaccgtgcgcaataatgtgtagacgcatccaaaatcaatctggcctttagcccagcacttaactcttgggatgaggcctgctttgtaaatgttgataatccagagaaaatgagcttttagattccaaagacagccagatatcttccacttatgcaaaatgcagagaatcatatttaacaaaagatgttctggacaaatatgcttcttgagggatgaatatttaattataagggaaatgataaatcaaacattaatgggaaaatatgtttgccctcaagattcatgattttgatgggtctctggcaaatcttatactatgtttattggggttattttattgctggttattagtttttaattgtttgcttgttttctgctctgatcaatttttgtataagccgtgggtctattcaccctcttctctccattcccgggagcaagtccacatctggctgttggatgcatggcaaaagcaaaggtgtggagaaggttcagaggagacaggacatgtataaaatggtagggtcaggttgtcatgggggaaactgaggcacaggaggcaagctgagttagtacaagaacagtctgaatcataacgacatgccagtattacctaaaaggatgaggaacatggagctgtacttgaatccctacgtgagctggggaaaaggggcctcaggaatcactgacattggaaccaaggtttgtctgcagcttgtcggtttctgggacagaaacccaacatactggagtgggtatcccagcaatctgtaggataaaccaggacactgtggtgtcatggatagctggctgtctgccaggtgatggcccctctggttgcaatgtgagccgggcaggtcatccatttggcagcatggtgagggctctggccccagttgctatgggagggaggatgctggcacagggcactgttcacagactgcctttgctccatgccttttccatgagcatgagtggctgttcgtgtgggaaacggcagagccctcgcggtccccatcagcactgtgcagtggtaccggaggtggcaggagacagcctgatggcccaggttgtcttcatacccggcttcatgccagggtgcatgccgggcatagcacatgtgtccctgagaggcccctgatcaggggtggaaacccagcaaagtgaaaatcagaaatagtgattctccagttcctgttcacagataaagaaagaaagaaataataagcaatactaggcctggtgtggtagttcacacctgtaatcccagcactttgggaggccaaggcaggcaatcacttgaggtcaggagttcaagaccagcctggccaacatggtgaaaccccgtctctactaaaaatacaaatattagccgggcatggtggcgggcgcctgtagtcccagctactcaggaggctgaggcagaagaatcgcttgaaccggggaggcggagggtgtggtgagccgggatcgcaccgctgcactccagcctgggtgacagaatgagactccatcccaaaaacaaaacaaaacaaaacaaaaaacaaacaaaaacaactaaaaggacagtatctttttagcacccatcagtgtacaggatgctggggagggtactgtgaacttacccatggtgaaagtccctgtgttaatggataagctcaatgctcagaaaatgctgctgactgtggtattgccccatttaaagagacagtttgcagtacgttttcagaagtggcatgcagcctcagagaaaagtcaccaggggctggcatgattccagaaaatgttacagagcaagtggaatttgacttgaggcttgaaggatgggcaagatttaaataaaattcagaaacggtagagagggaggggctggggggaaggctgcccactggactgtcctgtttgcctccaggagaacctacaggcaagacatggtctcttctcaggtgaatgggaagccaagtagggctggcatgggtgagccacagctcgaggaggcaggccccgggccctgcgctgcctgtcatggctcatgagtgatgggagagatctgggcaggcaacctcctctcatcctgcatcatcagcctggacttggaacttggctgctttttctttctgcagttagcagagggccttggccaacacataagcctttctgccagcacttggcattccagctgacctcgacccaaggcctctgtgacttcaggaggcggcagctgggaagggtcagggcagttccaggcagagcacagacgtcagctcagacatcctaccccccgccaaccccccgcccccggggtttccagagcaaccaacaccaccaagctccaggacactggaaaaaaaatctttgcaaagaagcaaggggccatctcagaaaatccaggtcccccaaattgatgtagggagaggagggctttgacagcattcagcactccagagggtcacgaggatacagaaaccatttggagccacctctgcttctcagccccacccaggcaagccctggatcttcaagggactgatttgtacctgggaataaactcatgcatggatgagattcagagtcaatcacaccctaaaatgcagagcccatagtattggtgagttgttcatgtgtctctgaagcaaatttagggctgtggttcaaacatcgtaaaagttaaaaaaaattcactggatacacacagtaggctcttttaaattagcctcatttgaacttaattacatatttaaatactcaaataataaatgatggctgggtgcggtgtctcatgcctgtaatcccagcactttgggaggctgaggcaggctgatcacttgaggtcaggagttcgagcccagcctggccaacatggtgaaaccccgtctctactaaaaatacaaaaattagccatgcatggtggcgggtgcctgtaatcccagctacttgggaggctgaggcagcagaagcacttgaacccaggaggcagtggttgcaatgagccgagatcgcaccactgcattccagcctgggtgacagagcaacactgtgtctcaaaagaaaattttttttaataaaaataaaaaataaaataaaataagtgagtccactgaaagcggtttctaccttgatagttgggtgtgtggcgtcatcaacatcacagaaggctgatcgatattaccaggtgtggttgagtgcaagtgtttgaggtctcgtgggggaagagtttggaattcagaatccattgaggccttcactcaccactttccctctctcgctgtgttcccaaatgtgccacttttctgttggctcacatgcacccatgctctatttgatattcagggctctgaatttcaagccagactcagtcagtgtgattgtcactgctttcctgtccttcctttatcatctgtagacttgggtcccgtttttgcaggttgatgttctgtcttcgctgggctctggactcactgctcacgagtgcggtgtctgcatgggcactgcccagacatgcactgttggtccctcgatggctgcatggtcaggcctcagggctctctgccaggccgacctacagcccatacagacctgatttctgggcctggatccaggggatgccatctgggaagtgcgggatcttcccacgatgtcactgtaaaactcaccagggaggttttagaaattgaaccggcatcattcagattccatcctgctttttggtcctgagaaaatcctgcttttccctgagtaactgggataatgggtcaccagctcccatgccctagatgaggactagttagcattttctagtgcctggagatttccagatggaagctgtacttgggtctgtgtatctttgttacaggattcaataattcatgcactgaatttcccttcccggcaactccagacaccaaatcgcttcccatggtgtcccccaatcacttaggaatttagcctgtgtctaaagaccctctctgcagcctgacgtggctagccatcccagtacttccacgtttttcatgcctttctccaacagcgttgccgtggccccttaggcggcgatcgttttatcaatggtcgctccctctttttatctgttggcaggagccctttttcaacgccctcgctggagtctggcctgcacgccttgctgaatgaagccggaacctcagccccgcttccctttgaaatgaatgttcctggggcgccctctcgtggattttggagctaatcgtctgtgaatgccaagtgatggcaactgccctcccgccgcgtctccagccggtgcgggggaacgagaccctgcgggagcattaccagtacgtggggaagttggcgggcaggctgaaggaggcctccgagggcagcacgctcaccaccgtgctcttcttggtcatctgcagcttcatcgtcttggagaacctgatggttttgattgccatctggaaaaacaataaatttcacaaccgcatgtactttttcattggcaacctggctctctgcgacctgctggccggcatcgcttacaaggtcaacattctgatgtctggcaagaagacgttcagcctgtctcccacggtctggttcctcagggagggcagtatgttcgtggcccttggggcgtccacctgcagcttactggccatcgccatcgagcggcacttgacaatgatcaaaatgaggccttacgacgccaacaagaggcaccgcgtcttcctcctgatcgggatgtgctggctcattgccttcacgctgggcgccctgcccattctgggctggaactgcctgcacaatctccctgactgctctaccatcctgcccctctactccaagaagtacattgccttctgcatcagcatcttcacggccatcctggtgaccatcgtgatcctctacgcacgcatctacttcctggtgaagtccagcagccgtaaggtggccaaccacaacaactcggagcggtccatggcactgctgcggaccgtggtgattgtggtgagcgtgttcatcgcctgctggtccccactcttcatcctcttcctcattgatgtggcctgcagggtgcaggcgtgccccatcctcttcaaggctcagtggttcatcgtgttggctgtgctcaactccgccatgaacccggtcatctacacgctggccagcaaggagatgcggcgggccttcttccgtctggtctgcaactgcctggtcaggggacggggggcccgcgcctcacccatccagcctgcgctcgacccaagcagaagtaaatcaagcagcagcaacaatagcagccactctccgaaggtcaaggaagacctgccccacacagccccctcatcctgcatcatggacaagaacgcagcacttcagaatgggatcttctgcaactgatcgtctccatgcgccctgctctgcggctgtgttcttatttattgcatgcgtcgcttccacaggggcccctcaagagctgtgactcgggagagctaccttactttgaccaacagcctgcccagtgtggatgtctcttacagagggggcccaaggaatcaccaccccgcttcagtgtaaacaacgtgccttgtccactttgggctccagagtctttcagatgtactaagctgctgacatcatccactgccttctgctgcatcctagacaccctccctgttgttcacagagagggaaggtcgtgggccacacaatgctgtgtgaccctctccgtgtgcctctgaatggtgttttgatgattttacactacatttcctgtgcgtagaatggatgcttgtatattcgtacatctctatgttacacagaatttgtgttgcaggtgtttgccatgtggtacctacatagaatctccatacaacacacaggtaacaggttatacaagtggattcagactgaacccccagtacaaggacattgttttgaactaggtggacatgccatccctggtctccttagactgacatgattctcatgttaaccaagttttaaaagttcaaattccccaaaaaggcttgtccaaggctggccccagatgtgtgggtctgacccacaccagccctgtgtcctgtcctttcagtcatttgtccctgcgtaattttaatcgtattccaaagcccaattatgtgatggttttcaggtttctgcaaattacagaagagccagccaagatcacccaggagcttgtgcccccagatgggccaaagaaagagcctatgaaggagaagcagaagcagacggctggcctggctcaccttcccacgccagtggggcaggggtctgcttcaggaaatggaagctgtccaggaaatgagcagagattcacaagacagcactttgattctatgttgagtttgtttctatattagaaaagcagcaagtcagtaatcccccgtggcatcacagctaagtagctgtggccaccggcagtttcacagcatcctgaaagctggcactgatcgtgactatcagtgaaagaagtttaattttcaggttagaaaatgtgatctggcagtttatgcattcttcagagtaatgtaataatacctatgtgatgctgtaattttacttttcaacataagttgaacccgtagcagtctgtttaccttgtaaagggattacttagaagacatttttgtacatgctcttccccaaggattgtacgtattatacaaatagatggaaagaaaagtgaacacgtttgtagaactttcataagcacacagttgctgtgttgagttctctttaaaaacaaggacaaaaccaaccagcgttcaaaggaacctcccatcagagtcccctaaagtattttaggttcagtgagcatttgcctgaataaaacctaaaagagtagtcttaacacattactaactttttctaagagaaattgattcctgttttgtcatctgatgcaatttgctcttataaagagacattttcataggttcagagtaactcacctccatgggctgaccaaaggcttttctaatttttgttactgatgagatgaaacctatttgtaaggagatcttccccaggagcatttctgttgccttcttgacatcaatgaaaagtagcatattctcttatgaaatagcatgagaaaacacagggcatttctaggacagtaaaacgttaaagtactggattaagaaaacaacaacaggctgggcgcagtggctcacacctgtaatcccagcactttgggaggctgaggcgggtggatcacctgaggtcaggagtttgtgaccagcctggccaacatagtgaaatcctgtttctactaaaaatacaaaaattagctggatgcgatagcacgtgcctgtagtcccagctactcgggaggctgaggctggagagttgctcaaacccgggaggcggagattgcagtgagccaagatcgcaccgctgcactccagcctgggtgacagagcgaccctctgtctcaaaaaataataataataataaataaaacaacaacaaaatgcatcagagagccaaaacattcagtattgcattttcacataggtgatgaaatgactttggaactttatctgtgttatagttatgagttgctttgggagacttggagctctctgtagctattgttcataacactttgctccataaccctgatgtccgcagtatctaagtatctcagccttcatccattaactctactagggagcccacagccaccatttccactaggaggtatcaatatttgtggtatgacataaggctcccttgaaataacaagacttttgagcaatctgaattaaaaatacatcaaaaaagtaatagcgctcatttgctaaatgcaaaaaataatcacctttgataccaatgtgcaccaatatgcctaactagctagccagctggagataatttaccagggaatgtttcaaagccctaaccttgaagtttggaaacaggtggtcttctatgctgcagagaaactatgcattaggtctcttttcaattagaaacctttactatttccaatgtatgtttgttaaaaataataataataaaaccaaaagcctttgtggaaaccca

SEQ ID NO: 29836 - DNA, 1594 bp, Homo sapiens
gcaaggcgggtggctccaccctgcgtcgggcctcagtcagcccccgggggaggccatgaacgccacggggaccccggtggcccccgagtcctgccaacagctggcggccggcgggcacagccggctcattgttctgcactacaaccactcgggccggctggccgggcgcggggggccggaggatggcggcctgggggccctgcgggggctgtcggtggccgccagctgcctggtggtgctggagaacttgctggtgctggcggccatcaccagccacatgcggtcgcgacgctgggtctactattgcctggtgaacatcacgctgagtgacctgctcacgggcgcggcctacctggccaacgtgctgctgtcgggggcccgcaccttccgtctggcgcccgcccagtggttcctacgggagggcctgctcttcaccgccctggccgcctccaccttcagcctgctcttcactgcaggggagcgctttgccaccatggtgcggccggtggccgagagcggggccaccaagaccagccgcgtctacggcttcatcggcctctgctggctgctggccgcgctgctggggatgctgcctttgctgggctggaactgcctgtgcgcctttgaccgctgctccagccttctgcccctctactccaagcgctacatcctcttctgcctggtgatcttcgccggcgtcctggccaccatcatgggcctctatggggccatcttccgcctggtgcaggccagcgggcagaaggccccacgcccagcggcccgccgcaaggcccgccgcctgctgaagacggtgctgatgatcctgctggccttcctggtgtgctggggcccactcttcgggctgctgctggccgacgtctttggctccaacctctgggcccaggagtacctgcggggcatggactggatcctggccctggccgtcctcaactcggcggtcaaccccatcatctactccttccgcagcagggaggtgtgcagagccgtgctcagcttcctctgctgcgggtgtctccggctgggcatgcgagggcccggggactgcctggcccgggccgtcgaggctcactccggagcttccaccaccgacagctctctgaggccaagggacagctttcgcggctcccgctcgctcagctttcggatgcgggagcccctgtccagcatctccagcgtgcggagcatctgaagttgcagtcttgcgtgtggatggtgcagccaccgggtgcgtgccaggcaggccctcctggggtacaggaagctgtgtgcacgcagcctcgcctgtatggggagcagggaacgggacaggcccccatggtcttcccggtggcctctcggggcttctgacgccaaatgggcttcccatggtcaccctggacaaggaggcaaccaccccacctccccgtaggagcagagagcaccctggtgtgggggcgagtgggttccccacaaccccgcttctgtgtgattctggggaagtcccggcccctctctgggcctcagtagggctcccaggctgcaaggggtggactgtgggatgcatgccctggcaacattgaagttcgatcatggt

SEQ ID NO: 29837 - DNA, 2340 bp, Homo sapiens
ctcactcggttcaaggcagcgcgactgcgggtggcgcacgaccagggcgcagaccttggggcgcgcggcccatggagtcggggctgctgcggccggcgccggtgagcgaggtcatcgtcctgcattacaactacaccggcaagctccgcggtgcgcgctaccagccgggtgccggcctgcgcgccgacgccgtggtgtgcctggcggtgtgcgccttcatcgtgctagagaatctagccgtgttgttggtgctcggacgccacccgcgcttccacgctcccatgttcctgctcctgggcagcctcacgttgtcggatctgctggcaggcgccgcctacgccgccaacatcctactgtcggggccgctcacgctgaaactgtcccccgcgctctggttcgcacgggagggaggcgtcttcgtggcactcactgcgtccgtgctgagcctcctggccatcgcgctggagcgcagcctcaccatggcgcgcagggggcccgcgcccgtctccagtcgggggcgcacgctggcgatggcagccgcggcctggggcgtgtcgctgctcctcgggctcctgccagcgctgggctggaattgcctgggtcgcctggacgcttgctccactgtcttgccgctctacgccaaggcctacgtgctcttctgcgtgctcgccttcgtgggcatcctggccgctatctgtgcactctacgcgcgcatctactgccaggtacgcgccaacgcgcggcgcctgccggcacggcccgggactgcggggaccacctcgacccgggcgcgtcgcaagccgcgctcgctggccttgctgcgcacgctcagcgtggtgctcctggcctttgtggcatgttggggccccctcttcctgctgctgttgctcgacgtggcgtgcccggcgcgcacctgtcctgtactcctgcaggccgatcccttcctgggactggccatggccaactcacttctgaaccccatcatctacacgctcaccaaccgcgacctgcgccacgcgctcctgcgcctggtctgctgcggacgccactcctgcggcagagacccgagtggctcccagcagtcggcgagcgcggctgaggcttccgggggcctgcgccgctgcctgcccccgggccttgatgggagcttcagcggctcggagcgctcatcgccccagcgcgacgggctggacaccagcggctccacaggcagccccggtgcacccacagccgcccggactctggtatcagaaccggctgcagactgacaccctcggcccacgactgtcttcccaagttttacagacttgttctttttacataaaggaatttgtaggaaatgcagccaaaggtgcagtcggaaaagatgcaggggaaatgtatttatgcagcgacaccccacaatgtgaacaaacagacaaaaaatctgtgccctcgtggaattgacgttctgcttgggaacacagaaaagaactcggtgatgaaataatggagatgattccagtgacaaacgacagagatggtgatggtggtcagggaagacctctctgcagaggtagtgacttgtgatgtgagctgagacctctgtcctgggaagaccaaaagaaaagcatttcaggatgagggaatggcatgcgcaaaggccctgaggctgaaatgtgcccatgtgttctaagaaatgcagcgatgctggtgtgcctggagcagggacggagggggagaatgggaggagacaaggagctgaaggagtagttcccgaaggaccttgtgggtgatatagaggacttcgcttttgctctgagtgaggtgggagccatagaagcttctaagcagaagagggacttgccctaattcaggtgatcacaggtgtcttgtggcctccatgggaggttgaaaaccagagaaggtgaaggggggctgcactgagccacaggaacaatgatggagattccagctaagcccagaccccgtggattctagatagattttagaggcagcagacagaattactgaggaattgagtgtaagagtggaataaagttatcaaggacaatgccaagggtggggcacccccaaatttgactctgggagactcagccaaatcctatctggtaataaaatttcttttttatttttcttttctttctttctttcttttttttttttttgagttgggatcttgtgctctgtcacccaggctggagtgcaatgggcacaattatagctcactgcagcctggaactcctgggatcaagcctggagttcctgcttcagcctccctagtagctgggactacaggcatgcaccaccatgcccagttaataaaatttcttcaaatgc

SEQ ID NO: 29838 - DNA, 2043 bp, Homo sapiens
gctcactcggttcaaggcagcgcgactgcgggtggcgcacgaccagggcgcagaccttggggcgcgcggcccatggagtcggggctgctgcggccggcgccggtgagcgaggtcatcgtcctgcattacaactacaccggcaagctccgcggtgcgcgctaccagccgggtgccggcctgcgcgccgacgccgtggtgtgcctggcggtgtgcgccttcatcgtgctagagaatctagccgtgttgttggtgctcggacgccacccgcgcttccacgctcccatgttcctgctcctgggcagcctcacgttgtcggatctgctggcaggcgccgcctacgccgccaacatcctactgtcggggccgctcacgctgaaactgtcccccgcgctctggttcgcacgggagggaggcgtcttcgtggcactcactgcgtccgtgctgagcctcctggccatcgcgctggagcgcagcctcaccatggcgcgcagggggcccgcgcccgtctccagtcgggggcgcacgctggcgatggcagccgcggcctggggcgtgtcgctgctcctcgggctcctgccagcgctgggctggaattgcctgggtcgcctggacgcttgctccactgtcttgccgctctacgccaaggcctacgtgctcttctgcgtgctcgccttcgtgggcatcctggccgctatctgtgcactctacgcgctcgctggccttgctgcgcacgctcagcgtggtgctcctggcctttgtggcatgttggggccccctcttcctgctgctgttgctcgacgtggcgtgcccggcgcgcacctgtcctgtactcctgcaggccgatcccttcctgggactggccatggccaactcacttctgaaccccatcatctacacgctcaccaaccgcgacctgcgccacgcgctcctgcgcctggtctgctgcggacgccactcctgcggcagagacccgagtggctcccagcagtcggcgagcgcggctgaggcttccgggggcctgcgccgctgcctgcccccgggccttgatgggagcttcagcggctcggagcgctcatcgccccagcgcgacgggctggacaccagcggctccacaggcagccccggtgcacccacagccgcccggactctggtatcagaaccggctgcagactgacaccctcggcccacgactgtcttcccaagttttacagacttgttctttttacataaaggaatttgtaggaaatgcagccaaaggtgcagtcggaaaagatgcaggggaaatgtatttatgcagcgacaccccacaatgtgaacaaacagacaaaaaatctgtgccctcgtggaattgacgttctgcttgggaacacagaaaagaactcggtgatgaaataatggagatgattccagtgacaaacgacagagatggtgatggtggtcagggaagacctctctgcagaggtagtgacttgtgatgtgagctgagacctctgtcctgggaagaccaaaagaaaagcatttcaggatgagggaatggcatgcgcaaaggccctgaggctgaaatgtgcccatgtgttctaagaaatgcagcgatgctggtgtgcctggagcagggacggagggggagaatgggaggagacaaggagctgaaggagtagttcccgaaggaccttgtgggtgatatagaggacttcgcttttgctctgagtgaggtgggagccatagaagcttctaagcagaagagggacttgccctaattcaggtgatcacaggtgtcttgtggcctccatgggaggttgaaaaccagagaaggtgaaggggggctgcactgagccacaggaacaatgatggagattccagctaagcccagaccccgtggattctagatagattttagaggcagcagacagaattactgaggaattgagtgtaagagtggaataaagttatcaaggacaatgccaagggtggggcacccccaaatttgactctgggagactcagccaaatcctatctggtaataaaatttcttttttatttttc

SEQ ID NO: 29839 - DNA, 2456 bp, Homo sapiens
aattgggaggggcctgtgcccgggagcagcgggaacctatctgctggtgggagaggactcaggctaaggtggcccccactgaagactcctgctaagcaacccactgaagacccctccgaatcatcgacggggcgtccttggggtgcagcccaggaagctcagttcacagccttggggcgcgcggcccatggagtcggggctgctgcggccggcgccggtgagcgaggtcatcgtcctgcattacaactacaccggcaagctccgcggtgcgcgctaccagccgggtgccggcctgcgcgccgacgccgtggtgtgcctggcggtgtgcgccttcatcgtgctagagaatctagccgtgttgttggtgctcggacgccacccgcgcttccacgctcccatgttcctgctcctgggcagcctcacgttgtcggatctgctggcaggcgccgcctacgccgccaacatcctactgtcggggccgctcacgctgaaactgtcccccgcgctctggttcgcacgggagggaggcgtcttcgtggcactcactgcgtccgtgctgagcctcctggccatcgcgctggagcgcagcctcaccatggcgcgcagggggcccgcgcccgtctccagtcgggggcgcacgctggcgatggcagccgcggcctggggcgtgtcgctgctcctcgggctcctgccagcgctgggctggaattgcctgggtcgcctggacgcttgctccactgtcttgccgctctacgccaaggcctacgtgctcttctgcgtgctcgccttcgtgggcatcctggccgctatctgtgcactctacgcgcgcatctactgccaggtacgcgccaacgcgcggcgcctgccggcacggcccgggactgcggggaccacctcgacccgggcgcgtcgcaagccgcgctcgctggccttgctgcgcacgctcagcgtggtgctcctggcctttgtggcatgttggggccccctcttcctgctgctgttgctcgacgtggcgtgcccggcgcgcacctgtcctgtactcctgcaggccgatcccttcctgggactggccatggccaactcacttctgaaccccatcatctacacgctcaccaaccgcgacctgcgccacgcgctcctgcgcctggtctgctgcggacgccactcctgcggcagagacccgagtggctcccagcagtcggcgagcgcggctgaggcttccgggggcctgcgccgctgcctgcccccgggccttgatgggagcttcagcggctcggagcgctcatcgccccagcgcgacgggctggacaccagcggctccacaggcagccccggtgcacccacagccgcccggactctggtatcagaaccggctgcagactgacaccctcggcccacgactgtcttcccaagttttacagacttgttctttttacataaaggaatttgtaggaaatgcagccaaaggtgcagtcggaaaagatgcaggggaaatgtatttatgcagcgacaccccacaatgtgaacaaacagacaaaaaatctgtgccctcgtggaattgacgttctgcttgggaacacagaaaagaactcggtgatgaaataatggagatgattccagtgacaaacgacagagatggtgatggtggtcagggaagacctctctgcagaggtagtgacttgtgatgtgagctgagacctctgtcctgggaagaccaaaagaaaagcatttcaggatgagggaatggcatgcgcaaaggccctgaggctgaaatgtgcccatgtgttctaagaaatgcagcgatgctggtgtgcctggagcagggacggagggggagaatgggaggagacaaggagctgaaggagtagttcccgaaggaccttgtgggtgatatagaggacttcgcttttgctctgagtgaggtgggagccatagaagcttctaagcagaagagggacttgccctaattcaggtgatcacaggtgtcttgtggcctccatgggaggttgaaaaccagagaaggtgaaggggggctgcactgagccacaggaacaatgatggagattccagctaagcccagaccccgtggattctagatagattttagaggcagcagacagaattactgaggaattgagtgtaagagtggaataaagttatcaaggacaatgccaagggtggggcacccccaaatttgactctgggagactcagccaaatcctatctggtaataaaatttcttttttatttttcttttctttctttctttcttttttttttttttgagttgggatcttgtgctctgtcacccaggctggagtgcaatgggcacaattatagctcactgcagcctggaactcctgggatcaagcctggagttcctgcttcagcctccctagtagctgggactacaggcatgcaccaccatgcccagttaataaaatttcttcaaatgc

SEQ ID NO: 29840 - DNA, 6804 bp, Homo sapiens
gtctttcttctctgggcgcccaccaacaatggatggcaactccctgctctcggtaccaagcaacttggagtcatcacggatgtatgacgttttggaaccgcagcagggcagaggctgtggcagctcaggaagcggcccggggaactccatcacagcctgtaagaaggttcttcgcagcaatagcctgctggagtcaacagactactggttgcagaatcagaggatgccctgccaaattggttttgtagaagacaagtctgaaaactgtgcttctgtctgctttgtgaatcttgatgtgaacaaggatgaatgcagcacagagcacctgcaacagaaactggtcaacgtttcaccagatcttccaaaacttatcagttccatgaatgtccaacaaccaaaagaaaatgaaattgttgtcctaagtgggttagcctctggaaatctccaggcagattttgaagtttcacagtgcccttggctgccagatatctgcttggtccaatgtgcaagagggaacagaccaaacagtaccaactgcatcatctttgaaatcaacaaatttctgattggtctggaactggtgcaggagcgacagctccacctggaaacaaacatcttgaaactggaggatgacacgaactgttccttatcttcaatcgaggaagactttctcaccgcttctgagcacttggaggaggaaagcgaggtggatgaatctaggaacgattatgaaaatataaatgtctcagccaatgttttggaaagtaaacagctaaagggagccacccaggtggaatggaattgcaacaaggaaaagtggctttatgctttggaagacaaatacatcaacaaatatcccacaccattgattaaaacagaacgatctccagaaaacctaacaaagaacacagccttgcagagtctagatccctcagccaagccatcacagtggaaaagagaagctgtggggaatgggagacaagccacacattattatcattcagaagcttttaaaggtcaaatggaaaaatcacaggcactgtatattccaaaagatgcttatttctccatgatggataaagatgtaccttctgcatgtgctgtggcagagcagagaagcaacctaaacccaggagaccatgaagacacaagaaacgctctccctcctagacaagatggagaagtcaccactggcaagtatgctacaaatttagcagaatccgtgctgcaggatgcatttattagattatctcaatctcagtccacattaccccaggaatctgcagtcagtgtttctgtaggaagttctctgcttcccagttgctattccacaaaagatacagtggtttctcggtcatggaatgagctccccaaaatcgtcgttgttcagagtccagatggcagtgatgctgccccacagccaggcatctcctcctggcctgagatggaagtctctgttgaaacctcaagcatcctctctggagagaactccagcagacaaccccagagtgctctagaagtggcgttagcttgtgcagccactgtgattggaactatttccagtccacaggccacagaaagactcaaaatggagcaagtggtctcgaactttcccccagggagcagtggtgcactgcaaactcaagcaccccaaggactcaaggaaccttccatcaatgagtactcctttccatctgctttgtgtggcatgactcaggtggccagtgccgtggctgtctgtggtctgggtgaaagagaagaggtgacatgctcagtggctccaagtggtagcctcccgcctgcagctgaggcttctgaagccatgcccccactttgtggtttagcaagcatggagcttggcaaggaagccattgccaagggattgctcaaggaggctgctctggttttaacaaggcctaatacctacagcagcattggagactttctggactccatgaacaggagaatcatggaaactgcttcaaagtctcagaccctgtgctcagaaaatgtcgtcaggaatgaactggcacataccctgtccaatgttatcctgaggcattccattgatgaagttcaccacaaaaatatgataatcgaccccaatgacaacaggcattcatctgaaattctggacaccttaatggaaagtacaaatcaactgcttttagatgtgatatgcttcacgttcaagaagatgagtcatattgtacggcttggtgaatgtcctgctgtcctttctaaggagaccatcagaaggagggagacagaaccaagctgccagccatctgatccgggtgctagtcaagcttggacaaaagccactgaatcctccagcagctctccacttagcaattcacacaacacgagtcttgtcatcaacaatcttgtggatggcatgtattcaaaacaagacaagggtggagtgaggccaggcctcttcaagaaccccacgctgcagtcacaattatcacgtagtcacagagtgcccgattcttcaactgctacaacatcctccaaggaaatatatctgaaaggaatagcaggagaggatacaaaaagccctcatcacagtgagaatgaatgcagagcctcttccgaaggacaaaggtccccaacggtcagccagtccagaagtggttcccaggaggctgaggagagtatccacccaaacacccaagaaaagtacaactgtgccacatctcgcatcaacgaagttcaagtcaacctgtccttgttaggggatgacctgctgcttcctgctcaatccacgcttcaaacaaagcatccagacatctactgcattacagactttgcggaagaattagcagacacggtcgtctccatggcaactgaaattgcagcgatttgccttgacaactccagtggaaaacaaccctggttttgtgcatggaaaagagggagtgagtttctgatgacacccaacgtaccctgccgatccttgaagaggaagaaagagagccaggggagcgggaccgctgtgaggaaacacaagcctccccggctcagtgagatcaagaggaagacggacgagcaccctgagcttaaagaaaagctgatgaacagggttgtggatgagtccatgaaccttgaagatgtcccagattctgtcaatctttttgccaatgaagtggcagccaagatcatgaacctaacggagttctctatggtggacggcatgtggcaggcgcagggctatccccggaatcggttactgagtggcgacaggtggagccggctgaaggcctccagctgcgaaagcattcctgaggaagactccgaggccagggcctatgtcaacagcctgggcttaatgagcacgctgagccagccggtcagcagggccagctctgtctccaagcagtcgagctgtgagagcatcaccgatgagttttccaggttcatggtgaaccagatggaaaatgaagggagaggatttgagttactgctggattactatgctggcaagaacgccagcagcattctgaactcagccatgcaacaggcgtgccggaaaagtgaccacctcagtgtgaggcctagctgtccctctaagcagtccagcacagagagcatcactgaggagttctacaggtacatgctgagggacatcgaaagagacagcagagaaagtgcctcctccagacggagcagccaggattggacagccggcctgctgtctccttctctgcgatccccagtgtgccacagacagtcgtccatgccagacagcagatccccatgctccaggctgacagtgaatgtgcccatcaaagccaactctttagatggctttgctcagaactgcccacaagatttcctaagcgtgcagccggtcagtagcgcgtcctcatccggtctctgcaaatctgactcttgcttgtatcggagaggtgggactgaccacatcaccaacatgttaattcatgaaacgtgggctagctccattgaggctctcatgcgcaagaacaaaatcattgtggatgatgcagaggaagctgacactgagcctgtttctggtggctctccctcgcaagcagagaagtgtgcaaatagattagctgcgagcaggatgtgcagtgggccaactctgcttgttcaggagtctctcgattgcccgaggaaagactctgttaccgaatgtaaacagcccccagtgtcatctttgagcaaaactgcttctcttacaaaccacagccctttagattctaaaaaagaaacttcctcgtgccaggaccctgtaccaataaaccacaaaaggcgatcactttgctcgagggaagtgcctttgattcagattgaaacagatcagagagaagcctgtgctggggaacctgaacccttcctttccaaaagcagcctcctagaggaagcagaagggcattcgaatgacaaaaacatcccagatgtggtgagaggtggagacacagccgtgagcgcttgtcaaatccatagtgacagccttgataccagagatgtaccagaggctgaagcctccacagaagccagagcccccgatgaggcccccaaccctccaagcagcagcgaggagagcacaggcagctggacccagcttgccaatgaggaagacaacccagatgacacaagtagctttctccagctcagtgagcgatccatgagtgaattagtagaagaaaagaagattcttaaaggacagtcagaaagcacagaggcacctgcatctggaccgcctacgggaacagccagcccccagaggagcctgctggtgatcaactttgacctggagccagagtgtccagatgccgagctccgagccactctgcagtggatagctgcctctgaactggggattcccaccatctactttaagaaatctcaggaaaacagaattgaaaagtttctagatgtcgtgcagctggttcatcggaagtcctggaaagtgggtgatatcttccatgcagttgtccagtactgcaaaatgcatgaggagcagaaggatgggagactgagtctctttgactggctcttggaactgggataataaggcagtctgccgtatagatcattccttccctttattccaacttagattacagtggtttgttctaaatgctctaaacattctcaaaacatcacatcacattagcagaactataaaaaaaaatctgctactcagatccactgcatacagaataagtcagaggaaaagcaaaatataggtctgtccaaattcatacaacttgtgggtgagttccaaagagcttggattagaagggctggacaaagagagaattcaatggggcccaaattagaatgcttataatgagacccaatctccaggaaaacaacactcacataagtttaatcatataaaatgatttgtaatgtctctaattagatgaatcaactagaaacaaactcagtggtcaaaataatttttaagagtattccgtaacctatattttacttttctgattatattaaggggctgccagcccggagaaatacttaagatatgggtgagaaatccccagacttttatacaaaagatttccactttcaaatcaatgtcagtagacattgataaaagtatagcagcatcctctactgaggtgatttcatttattccctgcagcccactgataaatatctcacttctcccaaatagtatgtggactcccagctaagcagaaaactattgtcattcaactgaagaagaggaagataaaagattgtcttgtttccatcactgtattacttgtgtaacatgattacataattcttatcctaagagaaagctttcatatttaaaaaaaagtcttttcagataaaatctgcttgtgtcttgaataatatgaaatacaaactttcactttattttattgtaaattataaagagattattgtcttaaataatatattgagttagcttcaagcttcctaaaatatgaagagattgttgtctaaagtcacatattgacattgagctcagtggcctgtttcatcacgtatgtgctgctacctgtacagcagacatgccgctccagtgacatttataatgacagaagcagggtaatggtcttgtgtttgacatgatcagttaggatcatagactttccctgactcgtagatattagccttgaattgggggaaaagaagactttgacacattttagttattttaataacagagatttactcttttgaaaaataaaggtatctaatgtctccctaataagtcttctttccttccaactaaatgacctacacggacttttattttcttgatcaaagaggtgtttattaaggacttctggataactatacttttactctatttttaaagatcacaaagtaattttaaatgtgaacaggttcccataccatgaatgctggcctcaccttctctatcatccacattttgaaatgcaaagaaagctcccttgtaagccatacttccttccccactcccatcctaggatacttgcccagtgctcattaggcatttcttattcagatagtccaaatttaggttattatgcttaatttgacacattaactaaatgcccagttttaaaatatatccatcaattcacgctgaaatgtgcttctttgtgctatcaaatggaatagaatacacttattttttaaacaatcccagaatactgtgtgtagacttttgttgtgctcaaataaatgtttacttatcttacaaagctcaaatactggattgtaaccatgtgatgaagttatctatgttgtacctaacattgcaaattaatcaataaatctctgttgtca

SEQ ID NO: 29841 - DNA, 6917 bp, Homo sapiens
tccttcgcctgcactttccgtctttcttctctgggcgcccaccaacaatggatggcaactccctgctctcggtaccaagcaacttggagtcatcacggatgtatgacgttttggaaccgcagcagggcagaggctgtggcagctcaggaagcggcccggggaactccatcacagcctgtaagaaggttcttcgcagcaatagcctgctggagtcaacagactactggttgcagaatcagaggatgccctgccaaattggttttgtagaagacaagtctgaaaactgtgcttctgtctgctttgtgaatcttgatgtgaacaaggatgaatgcagcacagagcacctgcaacagaaactggtcaacgtttcaccagatcttccaaaacttatcagttccatgaatgtccaacaaccaaaagaaaatgaaattgttgtcctaagtgggttagcctctggaaatctccaggcagattttgaagtttcacagtgcccttggctgccagatatctgcttggtccaatgtgcaagagggaacagaccaaacagtaccaactgcatcatctttgaaatcaacaaatttctgattggtctggaactggtgcaggagcgacagctccacctggaaacaaacatcttgaaactggaggatgacacgaactgttccttatcttcaatcgaggaagactttctcaccgcttctgagcacttggaggaggaaagcgaggtggatgaatctaggaacgattatgaaaatataaatgtctcagccaatgttttggaaagtaaacagctaaagggagccacccaggtggaatggaattgcaacaaggaaaagtggctttatgctttggaagacaaatacatcaacaaatatcccacaccattgattaaaacagaacgatctccagaaaacctaacaaagaacacagccttgcagagtctagatccctcagccaagccatcacagtggaaaagagaagctgtggggaatgggagacaagccacacattattatcattcagaagcttttaaaggtcaaatggaaaaatcacaggcactgtatattccaaaagatgcttatttctccatgatggataaagatgtaccttctgcatgtgctgtggcagagcagagaagcaacctaaacccaggagaccatgaagacacaagaaacgctctccctcctagacaagatggagaagtcaccactggcaagtatgctacaaatttagcagaatccgtgctgcaggatgcatttattagattatctcaatctcagtccacattaccccaggaatctgcagtcagtgtttctgtaggaagttctctgcttcccagttgctattccacaaaagatacagtggtttctcggtcatggaatgagctccccaaaatcgtcgttgttcagagtccagatggcagtgatgctgccccacagccaggcatctcctcctggcctgagatggaagtctctgttgaaacctcaagcatcctctctggagagaactccagcagacaaccccagagtgctctagaagtggcgttagcttgtgcagccactgtgattggaactatttccagtccacaggccacagaaagactcaaaatggagcaagtggtctcgaactttcccccagggagcagtggtgcactgcaaactcaagcaccccaaggactcaaggaaccttccatcaatgagtactcctttccatctgctttgtgtggcatgactcaggtggccagtgccgtggctgtctgtggtctgggtgaaagagaagaggtgacatgctcagtggctccaagtggtagcctcccgcctgcagctgaggcttctgaagccatgcccccactttgtggtttagcaagcatggagcttggcaaggaagccattgccaagggattgctcaaggaggctgctctggttttaacaaggcctaatacctacagcagcattggagactttctggactccatgaacaggagaatcatggaaactgcttcaaagtctcagaccctgtgctcagaaaatgtcgtcaggaatgaactggcacataccctgtccaatgttatcctgaggcattccattgatgaagttcaccacaaaaatatgataatcgaccccaatgacaacaggcattcatctgaaattctggacaccttaatggaaagtacaaatcaactgcttttagatgtgatatgcttcacgttcaagaagatgagtcatattgtacggcttggtgaatgtcctgctgtcctttctaaggagaccatcagaaggagggagacagaaccaagctgccagccatctgatccgggtgctagtcaagcttggacaaaagccactgaatcctccagcagctctccacttagcaattcacacaacacgagtcttgtcatcaacaatcttgtggatggcatgtattcaaaacaagacaagggtggagtgaggccaggcctcttcaagaaccccacgctgcagtcacaattatcacgtagtcacagagtgcccgattcttcaactgctacaacatcctccaaggaaatatatctgaaaggaatagcaggagaggatacaaaaagccctcatcacagtgagaatgaatgcagagcctcttccgaaggacaaaggtccccaacggtcagccagtccagaagtggttcccaggaggctgaggagagtatccacccaaacacccaagaaaagtacaactgtgccacatctcgcatcaacgaagttcaagtcaacctgtccttgttaggggatgacctgctgcttcctgctcaatccacgcttcaaacaaagcatccagacatctactgcattacagactttgcggaagaattagcagacacggtcgtctccatggcaactgaaattgcagcgatttgccttgacaactccagtggaaaacaaccctggttttgtgcatggaaaagagggagtgagtttctgatgacacccaacgtaccctgccgatccttgaagaggaagaaagagagccaggggagcgggaccgctgtgaggaaacacaagcctccccggctcagtgagatcaagaggaagacggacgagcaccctgagcttaaagaaaagctgatgaacagggttgtggatgagtccatgaaccttgaagatgtcccagattctgtcaatctttttgccaatgaagtggcagccaagatcatgaacctaacggagttctctatggtggacggcatgtggcaggcgcagggctatccccggaatcggttactgagtggcgacaggtggagccggctgaaggcctccagctgcgaaagcattcctgaggaagactccgaggccagggcctatgtcaacagcctgggcttaatgagcacgctgagccagccggtcagcagggccagctctgtctccaagcagtcgagctgtgagagcatcaccgatgagttttccaggttcatggtgaaccagatggaaaatgaagggagaggatttgagttactgctggattactatgctggcaagaacgccagcagcattctgaactcagccatgcaacaggcgtgccggaaaagtgaccacctcagtgtgaggcctagctgtccctctaagcagtccagcacagagagcatcactgaggagttctacaggtacatgctgagggacatcgaaagagacagcagagaaagtgcctcctccagacggagcagccaggattggacagccggcctgctgtctccttctctgcgatccccagtgtgccacagacagtcgtccatgccagacagcagatccccatgctccaggctgacagtgaatgtgcccatcaaagccaactctttagatggctttgctcagaactgcccacaagatttcctaagcgtgcagccggtcagtagcgcgtcctcatccggtctctgcaaatctgactcttgcttgtatcggagaggtgggactgaccacatcaccaacatgttaattcatgaaacgtgggctagctccattgaggctctcatgcgcaagaacaaaatcattgtggatgatgcagaggaagctgacactgagcctgtttctggtggctctccctcgcaagcagagaagtgtgcaaatagattagctgcgagcaggatgtgcagtgggccaactctgcttgttcaggagtctctcgattgcccgaggaaagactctgttaccgaatgtaaacagcccccagtgtcatctttgagcaaaactgcttctcttacaaaccacagccctttagattctaaaaaagaaacttcctcgtgccaggaccctgtaccaataaaccacaaaaggcgatcactttgctcgagggaagtgcctttgattcagattgaaacagatcagagagaagcctgtgctggggaacctgaacccttcctttccaaaagcagcctcctagaggaagcagaagggcattcgaatgacaaaaacatcccagatgtggtgagaggtggagacacagccgtgagcgcttgtcaaatccatagtgacagccttgataccagagatgtaccagaggctgaagcctccacagaagccagagcccccgatgaggcccccaaccctccaagcagcagcgaggagagcacaggcagctggacccagcttgccaatgaggaagacaacccagatgacacaagtagctttctccagctcagtgagcgatccatgagcaatggcaacagtagtgccactagcagtcttggcattatggatctggacatttatcaggaaagcatgccatcttctcccatgattaatgaattagtagaagaaaagaagattcttaaaggacagtcagaaagcacagaggcacctgcatctggaccgcctacgggaacagccagcccccagaggagcctgctggtgatcaactttgacctggagccagagtgtccagatgccgagctccgagccactctgcagtggatagctgcctctgaactggggattcccaccatctactttaagaaatctcaggaaaacagaattgaaaagtttctagatgtcgtgcagctggttcatcggaagtcctggaaagtgggtgatatcttccatgcagttgtccagtactgcaaaatgcatgaggagcagaaggatgggagactgagtctctttgactggctcttggaactgggataataaggcagtctgccgtatagatcattccttccctttattccaacttagattacagtggtttgttctaaatgctctaaacattctcaaaacatcacatcacattagcagaactataaaaaaaaatctgctactcagatccactgcatacagaataagtcagaggaaaagcaaaatataggtctgtccaaattcatacaacttgtgggtgagttccaaagagcttggattagaagggctggacaaagagagaattcaatggggcccaaattagaatgcttataatgagacccaatctccaggaaaacaacactcacataagtttaatcatataaaatgatttgtaatgtctctaattagatgaatcaactagaaacaaactcagtggtcaaaataatttttaagagtattccgtaacctatattttacttttctgattatattaaggggctgccagcccggagaaatacttaagatatgggtgagaaatccccagacttttatacaaaagatttccactttcaaatcaatgtcagtagacattgataaaagtatagcagcatcctctactgaggtgatttcatttattccctgcagcccactgataaatatctcacttctcccaaatagtatgtggactcccagctaagcagaaaactattgtcattcaactgaagaagaggaagataaaagattgtcttgtttccatcactgtattacttgtgtaacatgattacataattcttatcctaagagaaagctttcatatttaaaaaaaagtcttttcagataaaatctgcttgtgtcttgaataatatgaaatacaaactttcactttattttattgtaaattataaagagattattgtcttaaataatatattgagttagcttcaagcttcctaaaatatgaagagattgttgtctaaagtcacatattgacattgagctcagtggcctgtttcatcacgtatgtgctgctacctgtacagcagacatgccgctccagtgacatttataatgacagaagcagggtaatggtcttgtgtttgacatgatcagttaggatcatagactttccctgactcgtagatattagccttgaattgggggaaaagaagactttgacacattttagttattttaataacagagatttactcttttgaaaaataaaggtatctaatgtctccctaataagtcttctttccttccaactaaatgacctacacggacttttattttcttgatcaaagaggtgtttattaaggacttctggataactatacttttactctatttttaaagatcacaaagtaattttaaatgtgaacaggttcccataccatgaatgctggcctcaccttctctatcatccacattttgaaatgcaaagaaagctcccttgtaagccatacttccttccccactcccatcctaggatacttgcccagtgctcattaggcatttcttattcagatagtccaaatttaggttattatgcttaatttgacacattaactaaatgcccagttttaaaatatatccatcaattcacgctgaaatgtgcttctttgtgctatcaaatggaatagaatacacttattttttaaacaatcccagaatactgtgtgtagacttttgttgtgctcaaataaatgtttacttatcttacaaagctcaaatactggattgtaaccatgtgatgaagttatctatgttgtacctaacattgcaaattaatcaataaatctctgttgtcagattgtt

SEQ ID NO: 29842 - DNA, 1467 bp, Homo sapiens
ggcaaacagcccgcccggcaccaccatgctcgccctggaggctgcacagctcgacgggccacacttcagctgtctgtacccagatggcgtcttctatgacctggacagctgcaagcattccagctaccctgattcagagggggctcctgactccctgtgggactggactgtggccccacctgtcccagccaccccctatgaagccttcgacccggcagcagccgcttttagccacccccaggctgcccagctctgctacgaaccccccacctacagccctgcagggaacctcgaactggcccccagcctggaggccccggggcctggcctccctgcataccccacggagaacttcgctagccagaccctggttcccccggcatatgccccgtaccccagccctgtgctatcagaggaggaagacttaccgttggacagccctgccctggaggtctcggacagcgagtcggatgaggccctcgtggctggccccgaggggaagggatccgaggcagggactcgcaagaagctgcgcctgtaccagttcctgctggggctactgacgcgcggggacatgcgtgagtgcgtgtggtgggtggagccaggcgccggcgtcttccagttctcctccaagcacaaggaactcctggcgcgccgctggggccagcagaaggggaaccgcaagcgcatgacctaccagaagctggcgcgcgccctccgaaactacgccaagaccggcgagatccgcaaggtcaagcgcaagctcacctaccagttcgacagcgcgctgctgcctgcagtccgccgggcctgagcacacccgaggctcccacctgcggagccgctgggggacctcacgtcccagccaggatccccctggaagaaaaagggcgtccccacactctaggtgataggacttacgcatccccaccttttggggtaaggggagtgctgccctgccataatccccaagcccagcccgggcctgtctgggattccccacttgtgcctggggtcctctgggatttctttgtcatgtacagactccctgggatcctcatgttttgggtgacaggacctatggaccactatactcggggaggcagggtagcagttcttccagaatcccaagagcttctctgggattttcttgtgatatctgattccccagtgaggcctgggacgtttttaagatcgctgtgtgtctgtaaaccctgaatctcatctggggtgggggccctgctggcaaccctgagccctgtccaaggttccctcttgtcagatctgagatttcctagttatgtctggggccctctgggagctgttatcatctcagatctcttcgcccatctatggctgtgttgtcacatctgtcccctcatttttgagatcccccaattctctggaactattctgctgcccctttttatgtgtctggagttccccaatcacatctagggctcctcc

SEQ ID NO: 29843 - DNA, 847 bp, Homo sapiens
aaacagcccgcccggcaccaccatgctcgccctggaggctgcacagctcgacgggccacacttcagctgtctgtacccagatggcgtcttctatgacctggacagctgcaagcattccagctaccctgattcagagggggctcctgaccctggttcccccggcatatgccccgtaccccagccctgtgctatcagaggaggaagacttaccgttggacagccctgccctggaggtctcggacagcgagtcggatgaggccctcgtggctggccccgaggggaagggatccgaggcagggactcgcaagaagctgcgcctgtaccagttcctgctggggctactgacgcgcggggacatgcgtgagtgcgtgtggtgggtggagccaggcgccggcgtcttccagttctcctccaagcacaaggaactcctggcgcgccgctggggccagcagaaggggaaccgcaagcgcatgacctaccagaagctggcgcgcgccctccgaaactacgccaagaccggcgagatccgcaaggtcaagcgcaagctcacctaccagttcgacagcgcgctgctgcctgcagtccgccgggcctgagcacacccgaggctcccacctgcggagccgctgggggacctcacgtcccagccaggatccccctggaagaaaaagggcgtccccacactctaggtgataggacttacgcatccccaccttttggggtaaggggagtgctgccctgccataatccccaagcccagcccgggcctgtctgggattccccacttgtgcctggggtcctctgggatttctttgtcatgtacagactccctgggatcctcatgttt

SEQ ID NO: 29844 - DNA, 993 bp, Homo sapiens
cagaattgtcaatttattaatgaaatatgacgtgtgttgaacaagacaagctgggtcaagcatttgaagatgcttttgaggttctgaggcaacattcaactggagatcttcagtactcgccagattacagaaattacctggctttaatcaaccatcgtcctcatgtcaaaggaaattccagctgctatggagtgttgcctacagaggagcctgtctataattggagaacggtaattaacagtgctgcggacttctattttgaaggaaatattcatcaatctctgcagaacataactgaaaaccagctggtacaacccactcttctccagcaaaaggggggaaaaggcaggaagaagctccgactgtttgaataccttcacgaatccctgtataatccggagatggcatcttgtattcagtgggtagataaaaccaaaggcatctttcagtttgtatcaaaaaacaaagaaaaacttgccgagctttgggggaaaagaaaaggcaacaggaagaccatgacttaccagaaaatggccagggcactcagaaattacggaagaagtggggaaattaccaaaatccggaggaagctgacttaccagttcagtgaggccattctccaaagactctctccatcctatttcctggggaaagagatcttctattcacagtgtgttcaacctgatcaagaatatctcagtttaaataactggaatgcaaattataattatacatatgccaattaccatgagctaaatcaccatgattgctaaatatactttcatatttcatggtttactggcatcggaaatctctacaagttttaatgatttctccctccctctctttttttcctcctctgaagaaatttaggatttttctcttaaagcaaatactaaagaggaaaaaaaattaactttattgttgcttttatcaaagagtatgtaatctatactaacttgttgggaaattctgccaatgaacaactttttt

SEQ ID NO: 29845 - DNA, 1132 bp, Homo sapiens
ttattttcatgatagcctaccgttgaatttaccgttctgatattaatgaaacatctctataaagggttgaagtgtcttcccggattgtcaacttattttattttattttcttcaagcaacaattgctaaggaacagaattgtcaatttattaatgaaatatgacgtgtgttgaacaagacaagctgggtcaagcatttgaagatgcttttgaggttctgaggcaacattcaactggagatcttcagtactcgccagattacagaaattacctggctttaatcaaccatcgtcctcatgtcaaaggaaattccagctgctatggagtgttgcctacagaggagcctgtctataattggagaacggtaattaacagtgctgcggacttctattttgaaggaaatattcatcaatctctgcagaacataactgaaaaccagctggtacaacccactcttctccagcaaaaggggggaaaaggcaggaagaagctccgactgtttgaataccttcacgaatccctgtataatccggagatggcatcttgtattcagtgggtagataaaaccaaaggcatctttcagtttgtatcaaaaaacaaagaaaaacttgccgagctttgggggaaaagaaaaggcaacaggaagaccatgacttaccagaaaatggccagggcactcagaaattacggaagaagtggggaaattaccaaaatccggaggaagctgacttaccagttcagtgaggccattctccaaagactctctccatcctatttcctggggaaagagatcttctattcacagtgtgttcaacctgatcaagaatatctcagtttaaataactggaatgcaaattataattatacatatgccaattaccatgagctaaatcaccatgattgctaaatatactttcatatttcatggtttactggcatcggaaatctctacaagttttaatgatttctccctccctctctttttttcctcctctgaagaaatttaggatttttctcttaaagcaaatactaaagaggaaaaaaaattaactttattgttgcttttatcaaagagtatgtaatctatactaacttgttgggaaattctgccaatgaacaacttttttataata

SEQ ID NO: 29846 - DNA, 5417 bp, Homo sapiens
aacctgtggcgcgctccgcggttccggcgcctgaagttttagctgcggtggcggcggcagtcgggaccgactgcaaggcaggttgagatgatggatctgaggcttgcagctcgcagtcccaacgagccttagggaccagggctaccaaaagggtggggagaacggtggtggcatctgtctgttgcctgggatccaggcgcccggttggggaatccttacttcaggaagcgcagccgcggctctgtgttttgagagtgcaaatgtcatttgtcagagtgaaccgctgtggtccccgagttggtgtaagaaagacaccgaaagtaaagaagaagaaaacttcagtgaaacaagaatgggataataccgtgactgatctaaccgttcatcgggcaactcccgaagatctggtacgccgtcatgaaatacacaaatcgaagaatagagcattagtacactgggaactccaagaaaaagctttgaagagaaaatggaggaagcagaaaccagaaactttaaatcttgagaaaagaagattgtctatcatgaaggagattctttctgatcaataccagatgcaagatgtgttggagaaatctgatcatctaatagctgcagcaaaagagctgtttcctcgtaggcgcacagggtttccaaatgtaacagtggctcctgattcctctcagggtcccattgtggtaaatcaagaccctatcacccaatctatctttaatgagtctgtcatagaacctcaggctcttaatgatgtagatggtgaagaagaaggaactgttaatagccagtcaggagaaagtgagaatgagaatgagttggataactctctaaactctcagtctaacacgaatacagacaggtttctccaacaactaacagaagagaattttgagttaattagtaagttgtggactgacattcagcagaaaatagcaacccagtcacaaataactcctccaggaacgccatcatctgctctttcatcaggggagcaaagagctgctctgaatgctaccaatgctgtcaagagactccaaaccaggcttcagcctgaagaatctactgagactctagactcaagctacgttgtgggacacgtgctgaactcaaggaagcaaaaacagctgttaaataaagtgaaaaggaaaccgaatttgcatgctctttccaagccgaagaaaaacatatcatcaggtagcacaacctctgcagacttaccaaataggactaattccaacctggatgtcctcaaacacatgatacatgaagtggaacatgaaatggaagaatatgagcggtggacaggtcgcgaggtcaagggtctgcagagcagtcagggtcttacaggcttcactttgtcgctggtgagctccctctgtcgcctggttcggtaccttaaagagagtgagatccagctacgtaaagaagtagagacaaggcaacaactggaacaagtattaggtgatcatcgagagctcattgatgctctgacagctgaaattcttcgtcttagagaagaaaacgctgctacacaggcaagacttcagcagtacatggtcacaacagatgagcaactgatatcactcacacatgctattaagaactgtcctgtgataaataacagacaagaaattcaggcatcagaaagcggagccacaggtagaagagttatggacagtccagagcgtccagttgtaaatgccaatgtctcagtgccattgatgttcagagaggaagtggctgaattcccacaggaagagttgcccgttaaactgtctcaggtgccagaccctccagataacatgaatctggccaagaattttccagcacatatttttgagccagctgtgttgttaacaccacccaggcagaagagcaacttaaaattctctcctcttcaggacgtattgagaaggactgttcaaactcgtcctgctccacgacttcctccaactgtggaaataattgagaaggaacaaaattgggaagagaagaccttacctattgatacagacattcagaattcaagtgaagagaatcgtctcttcactcagagatggagagtctctcacatgggagaagatttggagaacaaaactcaggctccttttgttaacctctcacagcccctctgcaattcccattccaacactcaacagtcaagaagccccacattctcagaagagctcccagtactgggagatgggcagcagctgagaacaaatgagtcattaatacaaagaaaggacataatgacacgaattgctgatttgacattgcagaattcagctatcaaggcacatatgaataatattattgagcccagaggagagcaaggggatggactccgggagttgaacaaacaagaaagtgcaagtgacatgacttctacttttccagtagcacagtctctaacaccaggtagtatggaggaacggattgcagaattgaatcgacaaagtatggaggctcgtggaaaactactgcagttgatagagcagcagaaacttgttggtttgaatctttctccaccaatgtcacctgttcagttacctctcagagcatggactgaaggagcaaagaggacaattgaggtatctattccaggagcagaagccccagaaagctcaaaatgtagtactgtctctcccgtcagcgggataaatacaagaagatcttccggggctactggtaattcttgttctccactaaatgccacctcaggaagtgggagattcacacctcttaatccaagagcaaagattgagaaacagaatgaagaaggctggtttgctctttctacccatgtatcataagtgaagtcaagtctcactgagtttgttcttaataatttattacttccctttccctgctctgacttttaagtttttatatccttctttcagataaaacctacaaagatcctgtgaattagtactaatgaaacagagaaataaagcaattattttttgactttctcaaataagttttcaacaaccaactgacctacagctccctgtgaatgaaactttgactgtagagaagttaaagttttgtattttaatactttcttaagtattttaagggttttttttattaatacatttttacctttatctttattcagggttttttgaggtttagtatatcttagttgatccatttatttatttattttcctgaagaactaatttgctttgcatgtaacttacaataaaattcctctgtgtgattagagtctggctttcaggaatatgtaacacccacttttctttcttttttcttgggaagtcattgctgttcatcactttttccatcaagtgaaatatacagccttaaaaacaataggcctgggagtgtttgtttatatttgcttaagcaggtaagagtggttgcatttattataaaatcttatgtagtttttaaatgtgaaaatgtcatcaataatggtaatgcaaatcaaataaatatgattctagagctcaaatgcctaaatgtggtaacattgatttaatggtatatttaatgcttcaaacaattaaatagaaaaagttgctattaattttcccagccctgaatttaagcagatctttcagggtagatttctcttttttttttttttttgagacagagtcttgctttattgcccaggctggagtgcagttgtataatctggttcactgccacctcagtctcctgggttcaagcaatcctcttacctcagcctcctgagtagctaggattataggttcatgccaccacgcccagctaatttgtgtattttcagtagagacggggtttcaccatgttggccaggctgatctcgaactcctgacctcaaatgatccacctgccttggtttcccaaagtgccgggattacaggtgtgagccactgcacccggctcaggatagatttttcagggtacccttttggttctgagatgtttatttctattttaaacttgttttttgaatgatctctgctccctggctctatgataggaattctcaacctgagtgaacaattcaaactgagattacttgtgtttagactcatatattttgataacatatgacttctccagtatgccccagaaagctgctaataacttgctcaacctgaaatttacagttttccaaattacaggttggcagagatactggattgataacaacatccacagttatcatataatcattcttatgctgtaaacaaaattattttggttagcagaatttaataattaactgttaactacatactaggcaatattgtagccactttatgtgcttcatgacaccttatgggataggtactattatcctcattttgcagatgaggaaactgaggtacaaggaggtattttctcaaggtcacacaactagggagtggtggcattagaatgggaacataggcagtctttctccaaagcctatgctgtgctgcctcttgttggagagtaaacctgttttacagtgtgtgtagtatggaagcagcataataataagaatagctgttccttattgagccattactgtggcagacaccgtactataagctgtggtatcaccattatctcatttgaatctcatagtagacctatcagttagaggtatgtaaatgcttcctcctctcccagcacctttacagatgaggatgctgagccctagaggtgaagaaagttgtctaatgacagagtgcttgtaagaggtaaagccaagacttgaagctctttcttgcagttactggatttctcctaatttacgggaactaatacagtacagtagctaaggatgcaagtactgaaaccagaaatcttgcctcaaatgccatttctgccacttgagctgtgtactttggacaaattaatctaatctttcccatttgaaagtcagacataatgtcttccctagaggcttgtgaggattaagtgaggcaagtgtatgtaaatgggctgagatcagagcttggctcacaacactcagtaatgatcactgccaattttttttggtatataaataaataaatacactatttcccccatgtttccaatttttaagacattgtatagtgaatttattgtatctttctcagattaacaattgcacacagtgcttgaaatttagaggtatttcacctgaaaagatgtctagagattgaaagaaaacatgctgggcatatgatttgaaaatataaataacatgctatttaaaaataagtttaccctatgttttctatcttttctggcacctagatataccatttaataagtaatagcaaggataatcatttttttaagccctggaaaatcttgattaaagaggacatttcagtattgcaaataaatgcatggtatttgtgtaacattgtggaaactaataaacacaaattgtattatagcaa

SEQ ID NO: 29847 - DNA, 590 bp, Homo sapiens
aggcaacagcccggaagccgctggctgggttaacctgtggcgcgctccgcggttccggcgcctgaagttttagctgcggtggcggcggcagtcgggaccgactgcaagatgtcatttgtcagagtgaaccgctgtggtccccgagttggtgtaagaaagacaccgaaagtaaagaagaagaaaacttcagtgaaacaagaatgggataataccgtgactgatctaaccgttcatcgggcaactcccgaagatctggtacgccgtcatgaaatacacaaatcgaagaatagagcattagtacactgggaactccaagaaaaagctttgaagagaaaatggaggaagcagaaaccagaaactttaaatcttgagaaaagaagattgtctatcatgaaggagattctttctgatcaataccagatgcaagatgtgttggagaaatctgatcatctaatagctgcagcaaaagagctgtttcctcgtaggcgcacagggtttccaaatgtaacagtggctcctgattcctctcagggtcccattgtggtaaatcaagaccctatcacccaatctatctttaatgagtctgtcat

SEQ ID NO: 29848 - DNA, 568 bp, Homo sapiens
tcgagtatgcgcgtgcgcaccgctttcgggagcttttgcacagagctgatgtcatttgtcagagtgaaccgctgtggtccccgagttggtgtaagaaagacaccgaaagtaaagaagaagaaaacttcagtgaaacaagaatgggataataccgtgactgatctaaccgttcatcgggcaactcccgaagatctggtacgccgtcatgaaatacacaaatcgaagaatagagcattagtacactgggaactccaagaaaaagctttgaagagaaaatggaggaagcagaaaccagaaactttaaatcttgagaaaagaagattgtctatcatgaaggagattctttctgatcaataccagatgcaagatgtgttggagaaatctgatcatctaatagctgcagcaaaagagctgtttcctcgtaggcgcacagggtttccaaatgtaacagtggctcctgattcctctcagggtcccattgtggtaaatcaagaccctatcacccaatctatctttaatgagtctgtcatagaacctcaggctcttaatgatgtagatggtgaagaag

SEQ ID NO: 29849 - DNA, 556 bp, Homo sapiens
gagagtgcaagtacgtgtcagggtgcgtgtctgggtatgtttgtgcgtggcgccagagcacctcgagtatgcgcgtgcgcaccgctttcgggagcttttgcacagagctggtaattgggggtgctcgattgtagcgttgggggagttcaccgtgtagcaggagagaggcaaactatccagggtgctttgggaccgggagcgtcatttaaatcgatggatgtcagaggggcttctcagaaggctcctcctgtgagttttgaggagtccgtggaagttaacccagtagagaagagagtgagcctaatgagtgttccaagcagagggaaaagaatggttgcaactgtgtgtgaggcgagagcttggttttaggatttgcgggagatgtgagagaacactggaaagaaaagtcagccgggccatatgggggagagggtctgaatgccaagctgagttggattgcttttgacagtggggagccatccgaatctagaggaagtagatgtcatttgtcagagtgaaccgctgtggtccccgagttggtgtaagaaagacaccg

SEQ ID NO: 29850 - DNA, 4484 bp, Homo sapiens
tccgcggcgagggagcgggggcggggaggcgccgtctggctcaggctggggccggcgggagcgcgaacgagcgacggcggaacccgtgggcctgtggactgcagcctcggcggtcagcagagtgcttgtgatttcacgtatttttgctgaactcgtaaaagagacacttggatggtggattaaccagaacactaacattctgtgaaaagtttcaaattggagaatattgaattttcaccctagtccagcagctccgctgctcacttaaatacagatgaatgaagaccccattcggaaagacacctggccagcggtccagagctgatgcaggccatgctggagtatctgccaacatgatgaagaagaggacatcccacaaaaaacatcggagcagtgtgggtccgagcaaacctgtttcccagccccggcggaacatcgtaggctgcaggattcagcatgggtggaaagaggggaatggccctgttacccagtggaaaggaaccgttctggaccaggtgcctgtaaatccttctttgtatcttataaaatacgatggatttgactgtgtttatggactagaacttaataaagatgaaagagtttctgcgcttgaagtcctccctgatagagttgcgacatctcgaatcagcgatgcacacttggcagacacaatgattggcaaagcagtggaacatatgtttgagacagaggatggttctaaagatgagtggaggggaatggtcttagcacgtgcacctgtcatgaacacatggttttacattacctatgagaaagaccctgtcttgtacatgtaccaactcttagatgattacaaagaaggcgaccttcgcattatgcctgattccaatgattcacctccagcagaaagggaaccaggagaagttgtggacagcctggtaggcaaacaagtggaatatgccaaagaagatggctcgaaaaggactggcatggtcattcatcaagtagaagccaagccctccgtctatttcatcaagtttgatgatgatttccatatttatgtctacgatttggtgaaaacatcctagatgtcatcacaaactctgccaaatttgtggaactatgaaatgtattatttgtagacataaagacttgattgctttccagtttaatgaaagcttaaatgtccctgcgaacccacaatctctgccagcagaactggttttgttctgaatagtacagattgatgtgaacacaaagcattttgtgtaaggagaacccctttcttttaaaagaagtctgtctatttcgaggggagttacaggcaagtttggtaaaagttaagctagtatcatagtcatttaaaattgtaatagatcttaaccattttccccctcaccctaactctcttattctgccgccacaatgcaagcatagtttgatgttttcgttattgccttttttgagatgtatgtatctgtatctacctatatctatatgtgtgtatacatatataatatatacacacagatacaagtgtacacacacacaccacacaccacacacaccccactggcagtctttgtggattaggatgggggtgacataattttcttgagtttaacaggagtgctttacccaagtcagtcatggatatgatatcactgctctttatttaaaagtaaactttgggcacaggaaccatatgggaacattcagcttgtttaaaaaaaaaaaatcagaagttcagagcaccttttcaatctggagcccttaaaccataagtccaaatatgaattatttgtgaacagttaatgacccatattagaattttacaatctggtgaacaatctgggtaaaaggctacctttaattctaagcttcatttttttttgggggggggttacattttaatcataaattcttttttgcaaagcccaggttcttgttccacacagtgtaatgtaggtgtattttggacagcacatatggtccattgtgtacaagtcagtaatctggatttcagtacatggatttaaaaggcaacaatccatcactggtttgtgtgtttttggttaagtttctggaagaatacaatgcttttatattggaagtataagttttgagtggcattgttgccttctaacaagctctctgggacttttaaagttttattactattattgctaatgtatgattatggtcagagactttcaacccaccccttcctgcctacccctggcttttcctcacaaagaatgtctagacaaacagcagcttagtctcctgacacctcttgtggggtgcatgttcctgctccaggtatgctgttcatgtggattcattccattcagtggccccttggggtttgcatgccagtgaagcgttaccatagaagagccagccgtttgtgttcgcttggtaggtgtaagtaatagcagcccttagccacggagtctttatgtggtttattcctgcaaggttgttttaaactgaaatagaactgctagtgtgattggttgatcagcaaaacagctgctctcattttgttttggaggaaccctggtggtttgacagccaggagaaaggccatatgtgaaaccagtctcttgtggagattggaaatcctccctgatatttgggcagagcctaaacgtgcatgcttgtcactcaaacaccagaagtttgaatcagaggtctgagtgacctcttttgtggctgttcttgatggtttccaggcctcgttatgcatggtttgcttgatgcccattttttgtgccttgtgctgttggatggtaacgaccactcaccatgtaaacacagtacctcagttttctgtccacagctgcagtcgctctgtccctcgtgcttcactgtgggcagccagggacaagcttctgaaagcagtgtgatacccaagtcataggtgcttctcgtatgtgaacaggtgtcattctacagatctgttatgtgttttcctgttgactcttaagagtccctgcatgtaaatctcaaagctgagcctggctcccagagtccagactgacattacagcgcaagagtttgcaagtgtgtccagcatgcaccaactgtgcagaacttggctcggtaactttgcgtggaaaaataaagtacattttgaagtatcttgagggttgggtcaattgagacatttctagcattacttaatgacttgcattgtggtttttctgcaagcaactttaatgactttttttataccacatggtctcccagtttctagatgaatgcaacatgatgatggtgatgatgacgatgagtttaatcattgttcatttattgcctttagggctgagggaaagggaaggtttgtttttttttctccccattttcccccattctgtctttcttttggtgacttacaccacatgtaatgacgctatgactaattctgctcccaagcccttgtatcttgggcttcattttaggctcatgtgtcagatctgcatgcattgcttgcatttttctggtatctgaatgttggttccttgttccaggaattcaacattaatttccaaaagtatcatgggacttgtgacaatacaagacatgaatctatgtataaaatttatcggcctttctcatttacctgctctagtattattgtattgtgtgtgcgtgcgtgtgtgatgtcaggctgccacgtaaaacttcagagaaaaatcttaaaagcagaccatccttttttgcatgctctattctaagtagaatgttcaatgtaactgactaaaattgcatgttaaagatatttaggtttttttgttttctttatttttatttgttttcagtttcctgtatatttgcttactgtgccgttttagtggttttaggataaaaatgcactggtgaagcaaatgtagtgccaacagaaggtgattttccagttgtaaatgtcatgcagcatttgaagggactgtgttttcttaaaaaaaaatcacagttacttctaaaccagatttcatttcttttattgttttatgtgccaaaccacgaagtgcattgggcttcaatctctgaacactgtagacccattagaagactgttccgattgttacaaattgtagtgcctgaaaacactcttaagctgattgtcttaacaaaatgaaagttctccaaagacaaaacagaacaattattataacaaaataattatggttgaaatgtctgtggttccttggaaatgctgcgctctttgtgtttttccatcattagtgcagttggaatgaatgtgtataggtcagaggtcttcgtgttcacattttaaaattaggtaaatgacctcatctttcaagcttgaattcatttttaattttaattttattttatacaatgtgtagacagttccctgttctctgcatttagaagtatacacaatataaatctgttaattctgtaagtaatttttataattatgatgtaactctatcttatccttaaaacatttaaaataaaccctttatgtgcaa

SEQ ID NO: 29851 - DNA, 2082 bp, Homo sapiens
gagcgggggcggggaggcgccgtctggctcaggctggggccggcgggagcgcgaacgagcgacggcggaacccgtgggcctgtggactgcagcctcggcggtcagcagcaatgaggtcttactgtgtagcccaggctgctctggaactcctggactcaagtgatcttcctaccttggtcttccaaagtgttgggattacagatggagtttcgctcttgttgcccaggctggagtgtagtagcatgatctcggctcactgcaacctccgcctcctgagttcaagtgattctcctgcctcagcctcccgagtatctgggattacaggaagtttatctcgacaatgctagttgcagtctgtgtgaccctgaccaagttattttaatgtctgtgctgcagtttttcagtttccaagatggaatagttatagtgcatatcttcctcatggttgtgaggagtgcatgacacatagcgagtgctcagtgaacagtcatttttctgagtgcttgtgatttcacgtatttttgctgaactcgtaaaagagacacttggatggtggattaaccagaacactaacattctgtgaaaagtttcaaattggagaatattgaattttcaccctagtccagcagctccgctgctcacttaaatacagatgaatgaagaccccattcggaaagacacctggccagcggtccagagctgatgcaggccatgctggagtatctgccaacatgatgaagaagaggacatcccacaaaaaacatcggagcagtgtgggtccgagcaaacctgtttcccagccccggcggaacatcgtaggctgcaggattcagcatgggtggaaagaggggaatggccctgttacccagtggaaaggaaccgttctggaccaggtgcctgtaaatccttctttgtatcttataaaatacgatggatttgactgtgtttatggactagaacttaataaagatgaaagagtttctgcgcttgaagtcctccctgatagagttgcgacatctcgaatcagcgatgcacacttggcagacacaatgattggcaaagcagtggaacatatgtttgagacagaggatggttctaaagatgagtggaggggaatggtcttagcacgtgcacctgtcatgaacacatggttttacattacctatgagaaagaccctgtcttgtacatgtaccaactcttagatgattacaaagaaggcgaccttcgcattatgcctgattccaatgattcacctccagcagaaagggaaccaggagaagttgtggacagcctggtaggcaaacaagtggaatatgccaaagaagatggctcgaaaaggactggcatggtcattcatcaagtagaagccaagccctccgtctatttcatcaagtttgatgatgatttccatatttatgtctacgatttggtgaaaacatcctagatgtcatcacaaactctgccaaatttgtggaactatgaaatgtattatttgtagacataaagacttgattgctttccagtttaatgaaagcttaaatgtccctgcgaacccacaatctctgccagcagaactggttttgttctgaatagtacagattgatgtgaacacaaagcattttgtgtaaggagaacccctttcttttaaaagaagtctgtctatttcgaggggagttacaggcaagtttggtaaaagttaagctagtatcatagtcatttaaaattgtaatagatcttaaccattttccccctcaccctaactctcttattctgccgccacaatgcaagcatagtttgatgttttcgttattgccttttttgagatgtatgtatctgtatctacctatatctatatgtgtgtatacatatataatatatacacacagatacaagtgtacacacacacaccacacaccacacacaccccactggcagtctttgtggattaggatgggggtgacataattttcttgagtttaacaggagtgctttacccaagtcagtcatggatatgatatcactgctctttatttaaaagtaaactttgggcacaggaaccatatgggaacattcagcttgtt

SEQ ID NO: 29852 - DNA, 2213 bp, Homo sapiens
gtcacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacctgggtagctcaggggaggaggtgggggtccaggagggggatccctctccacaggggcagccccaagggctcggtgctatttgtaacggaataaaatttgtagccagacccca

SEQ ID NO: 29853 - DNA, 2125 bp, Homo sapiens
gtcacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacctgggtagctcaggggaggaggtgggggtccaggagggggatccctctccacaggggcagccccaagggctcggtgctatttgtaacggaataaaatttgtagccagacccc

SEQ ID NO: 29854 - DNA, 2056 bp, Homo sapiens
gtcacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacctgggtagctcaggggaggaggtgggggtccaggagggggatccctctccacaggggcagccccaagggctcggtgctatttgtaacggaataaaatttgtagccagacccc

SEQ ID NO: 29855 - DNA, 1990 bp, Homo sapiens
gtcacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacctgggtagctcaggggaggaggtgggggtccaggagggggatccctctccacaggggcagccccaagggctcggtgctatttgtaacggaataaaatttgtagccagacccc

SEQ ID NO: 29856 - DNA, 4349 bp, Homo sapiens
gggcggggccgggccgcagctgtcagagccgcggcggcgaacgaggcgcagcgagctgagcggtggcagcgccgcagccggggccggagcgcaggagccgacggggcccgaccaggatggtgcagtggcggctccgcggcgcacgcacgcgctgagcgggcccagcctgggccccgcgccccccgcgccccccgccgccccgatccgggccggcatgatgtgcctggaatgcgcctcggcggcggcgggcggcgcggaggaggaggaggcggacgcggagcggcggcgccggcgccggggggcgcagcgaggggctggcggtagcggttgctgcggggcgcggggcgcgggcggcgctggagtctcggccgcgggcgatgaggtgcagacgctgtcgggcagcgtaaggcgggccccgaccggaccccccggcacccccggcacccccggctgcgcagctactgcaaagggccccggcgctcagcagcccaaaccggccagcttgggccgcgggcggggggcagccgccgccatcctcagcttgggcaacgtgctcaactacctggacaggtacaccgtggcaggcgtccttctggacatccagcagcactttggggtcaaggaccgaggcgccggcctgctgcagtcagtgttcatctgtagcttcatggtggctgcccccatcttcggctacctgggcgaccgcttcaacaggaaggtgattctcagctgcggcattttcttctggtcggccgtcaccttctccagctccttcattccccagcagtacttctggctgctggtcctgtcccgggggctggtgggcatcggggaggccagctactccaccatcgcccccactatcattggcgacctcttcaccaagaacacgcgtacgctcatgctgtccgtcttctacttcgccatcccactgggcagtggcctgggctacattactggctccagcgtgaagcaggcagccggagactggcactgggcattgcgggtgtcccctgtcctgggcatgatcacaggaacactcatcctcattctggtcccagccactaaaaggggtcatgccgaccagctcggggaccagctcaaggcccggacctcatggctccgagatatgaaggccctgattcgaaaccgcagctacgtcttctcctccctggccacgtcggctgtctccttcgccacgggggccctgggcatgtggatcccgctctacctgcaccgcgcccaagttgtgcagaagacagcagagacgtgcaacagcccgccctgtggggccaaggacagcctcatctttggggccatcacctgctttacgggatttctgggcgtggtcacgggggcaggagccacgcgctggtgccgcctgaagacccagcgggccgacccactggtgtgtgccgtgggcatgctgggctctgccatcttcatctgcctgatcttcgtggctgccaagagcagcatcgtaggagcctatatctgtatcttcgtcggggagacgctgctgttttctaactgggccatcactgcagacatcctcatgtacgtggtcatccccacgcggcgcgccactgccgtggccttgcagagcttcacctcccacctgctgggggacgccgggagcccctacctcattggctttatctcagacctgatccgccagagcactaaggactccccgctctgggagttcctgagcctgggctacgcgctcatgctctgccctttcgtcgtggtcctgggcggcatgttcttcctcgccactgcgctcttcttcgtcagcgaccgcgccagggctgagcagcaggtgaaccagctggcgatgccgcccgcatctgtgaaagtctgaggtggtgccattgggacaatgaagaacccacactcccacctcgtctgggaggtgtcctacagcgtccgggaccggctgggctgccccaaagctttctgtgtgatccacggctaggcacccaccctctctggcccaggcctgctgagtggccctggcatcaagaagaggctgtgtcctcagttaccctggaaggatgtgtgtgttggagccacacggttggacaggttcccagccctaggtttgggccgcagggcccctggggccaaggaagaagacagccccaagtgggtgtccggggagagcctggcctgccaccagcttatgtgatcttgggcaagtccctgccctccctggaacgaagggccagggggctggactttcccacacaacttgctgggcaaagcacgatctgcagctttgaagactcaacagaccctggaccatacggagagcaggtggcccaggcctcagggcggcagtcccggctttgaggctcacgcgagggcctggtatgcagggaccactgctcagctgggcctcggaccttggggatattggacgcaacctggcaaatgaagctgggcgcccaagtctctgggtactccctggaggacactgtctcactgtctcgggttggctcccagcctggaggtcccagatggggactgttctgacaagctggcatcaccaggggtgaaggccctggctgcagctgtacaccacctgtgcccccaggctcaaggtctctggcaggtgcacaccagcccaactctgcagggcttctctccctgccaccaccccccaagccaggaccccactccttccccgaggctgagctgagccttttccaggggcagggcccaggagaccattcccagaatccatggggcagtagccagggctccggctgctggaggaagcagctatccacaaagcttcctgccccagagctgaggctgaggccccgggagaggcggcccctacccaaacactggctgctggcattccaccaagtgaccccaggggggggccaggccttcgatcacccacctcccatccatgcacacaccaggatgcagctgccaacttcacaccagccccaacccgctttgggggagcttagccccctgcgtcacccactccctgcacttctgctgcaatcaaggtggttctggtgcgggggtggggtggggggtgaggccttgtggccaatgggggaccccccaagagccagcttggacaatgctcttcttgccccttagttactggctggctgtggcttcagtggtgtgtaagcaggtggaatactcacccaccaagctctggggtaccccgagggcctgacaagaggatggggtgggggtggcatcctccaaagaccagcctccacccccactccagcctcagcggggccccagcgatgttttcttgttgtacaagaaccaggtccgagtgttgcctcctcttccttccggaagccaaactgctcctttattttttagagctgctgattgtgaatctcagagtcttaagagagaagccaaatatattcctcttgtaaatgaagaaataaacctatttaaatcaccccctggtggctccctcacagcaaaaaagcctgggggcaaagaggtggcaggcacgagagatggtcacacctgcctgcagccagcacatcaacctgcaccaacccaggcaaacaccagagccctggacatggccctggagccagggtcccagcccagaaccgggggtggggaggtctctgcaccctgggacccctgcaggaatggctcaggctgtgcttgccagagcaggatgcccgggcaggcggcaacagccaccctccccagtggcagcgccttagaaacagcttgcgtattaaaatcatggtttaaaaaaaaaaaaaaaaaataggcgtctcaggcagatggaggcaggggctgaggggggcccgtacctgtgctcagggcttccctgccttcctcacctgtgctttcttcttggccccactctgaagcaggctgggactcctgatgaccaaagacagccttgcctttttccgtgccagcgcggacagtggtgatttgcccaagaccccctttttgggaagagccttctgatgctgcttttggcctgcaggttccgtgggggacccgggagctccattcacctgggacggcttctggtttttcttctgcagttttggggatttggcaggggtgctggggctccgggtgggggcgccaggggctggactcttggtggttggcgtcccgtttgcctgggctgggaccttagcctttgtcctgttcctcttcttcctgcccatgctggggggctggctcccgccggtggctgcaggtgtgccatcctccgctggcgtgccatcctctgacttgcgtttcttgcgcttcttcgtctctggcaagaatccctttttcttccgcttcttactgatggggctctgggtggcactggggat

SEQ ID NO: 29857 - DNA, 1755 bp, Homo sapiens
gcttcatcctggcgccagtctcaggccaagagctgcaggctggcatggctggggggatgtcagcggagtgccctgagcctgggccaggaggtctgcagggccagtccccagggccaggcaggcagtgtccccctcccatcacgcccacctcctggagcctgcccccgtggagggcctacgtggctgccgccgtcctctgctacatcaacctcctgaattacatgaactggttcatcattgcaggagtgctgctggatatacaggaggttttccagatcagtgacaaccatgctggtttgcttcagactgtattcttggctcttcttcctgtcccggggcatcgtgggcactggctcggccagctactccaccatcgcgcccaccgtcctgggcgacctcttcgtgagggaccagcgcacccgcgtgctggctgtcttctacatctttatccccgttggaagtggtctgggctacgtgctggggtcggctgtgacgatgctgactgggaactggcgctgggccctccgagtcatgccctgcctggaggccgtggccttgatcctgcttatcctgctggttccagacccaccccggggagctgccgagacacagggggagggggccgtgggaggcttcaggagcagctggtgtgaggacgtcagatacctggggaaaaactggagtttcgtgtggtcgaccctcggagtgaccgccatggcctttgtgactggagccctggggttctgggcccccaagtttctgctcgaggcacgcgtggttcacgggctgcagcctccctgcttccaggagccgtgcagcaaccccgacagcctgatttttggggcactgaccatcatgaccggcgtcattggggtcatcttgggggcagaagctgcgaggaggtacaagaaagtcattccaggagctgagcccctcatctgcgcctccagcctgcttgccacagccccctgcctctacctggctctcgtcctggccccgaccaccctgctggcctcctatgtgttcctgggccttggggagctgcttctgtcctgcaactgggcagtggttgccgacatcctgctgtctgtggtggtgcccagatgccgggggacggcagaggcacttcagatcacggtgggccacatcctgggagacgctggcagcccctatctcacaggacttatctctagtgtcctgcgggccaggcgccctgactcctatctgcagcgcttccgcagcctgcagcagagcttcctgtgctgcgcctttgtcatcgccctggggggcggctgcttcctgctgactgcgctgtacctggagagagacgagacccgggcctggcagcctgtcacagggaccccagacagcaatgatgtggacagcaacgacctggagagacaaggcctactttcgggcgctggcgcctctacagaggagccctgaggtccctgcctacactcgtcctgcctgcaagcctcccgttggtccccacagcagcagtgcctcggttcctctttggctgtcctcggggactccggctgaggcacatctgccacttttgaattcccggctggagagctggcaggaccctgtggctgggctgggaatggagctgtcagcactctgcgtgggaggcctgggcctgtgcctgcatcccgctcaaggctgccccagcctggggtctccagcctggctgctgctgggccctgaataaagagaggccagtacaaagcccatggattttgggcctgt

SEQ ID NO: 29858 - DNA, 1892 bp, Homo sapiens
gcttcatcctggcgccagtctcaggccaagagctgcaggctggcatggctggggggatgtcagcggagtgccctgagcctgggccaggaggtctgcagggccagtccccagggccaggcaggcagtgtccccctcccatcacgcccacctcctggagcctgcccccgtggagggcctacgtggctgccgccgtcctctgctacatcaacctcctgaattacatgaactggttcatcattgcaggagtgctgctggatatacaggaggttttccagatcagtgacaaccatgctggtttgcttcagactgtcttcgttagctgcctgctgctgtctgcacctgtgtttggctacctgggcgaccgacatagccgcaaggctaccatgagcttcggtatcttgctgtggtcaggagctggcctctctagctccttcatctccccccggtattcttggctcttcttcctgtcccggggcatcgtgggcactggctcggccagctactccaccatcgcgcccaccgtcctgggcgacctcttcgtgagggaccagcgcacccgcgtgctggctgtcttctacatctttatccccgttggaagtggtctgggctacgtgctggggtcggctgtgacgatgctgactgggaactggcgctgggccctccgagtcatgccctgcctggaggccgtggccttgatcctgcttatcctgctggttccagacccaccccggggagctgccgagacacagggggagggggccgtgggaggcttcaggagcagctggtgtgaggacgtcagatacctggggaaaaactggagtttcgtgtggtcgaccctcggagtgaccgccatggcctttgtgactggagccctggggttctgggcccccaagtttctgctcgaggcacgcgtggttcacgggctgcagcctccctgcttccaggagccgtgcagcaaccccgacagcctgatttttggggcactgaccatcatgaccggcgtcattggggtcatcttgggggcagaagctgcgaggaggtacaagaaagtcattccaggagctgagcccctcatctgcgcctccagcctgcttgccacagccccctgcctctacctggctctcgtcctggccccgaccaccctgctggcctcctatgtgttcctgggccttggggagctgcttctgtcctgcaactgggcagtggttgccgacatcctgctgtctgtggtggtgcccagatgccgggggacggcagaggcacttcagatcacggtgggccacatcctgggagacgctggcagcccctatctcacaggacttatctctagtgtcctgcgggccaggcgccctgactcctatctgcagcgcttccgcagcctgcagcagagcttcctgtgctgcgcctttgtcatcgccctggggggcggctgcttcctgctgactgcgctgtacctggagagagacgagacccgggcctggcagcctgtcacagggaccccagacagcaatgatgtggacagcaacgacctggagagacaaggcctactttcgggcgctggcgcctctacagaggagccctgaggtccctgcctacactcgtcctgcctgcaagcctcccgttggtccccacagcagcagtgcctcggttcctctttggctgtcctcggggactccggctgaggcacatctgccacttttgaattcccggctggagagctggcaggaccctgtggctgggctgggaatggagctgtcagcactctgcgtgggaggcctgggcctgtgcctgcatcccgctcaaggctgccccagcctggggtctccagcctggctgctgctgggccctgaataaagagaggccagtacaaagcccatggattttgggcctgt

SEQ ID NO: 29859 - DNA, 679 bp, Homo sapiens
agacaaggtttccctctgtaacccaggctggagtgcagtggaacttctgagctcaagtagtcttcacatctcagccttccaagtagctgtgactagagcttgtgacagtccagccccttcagcctggagttccacctaccagtccccacatgtgctgtctctcaccaaggttgccagtgacctctgaccaaaacaatcttgggcgcaggagttagtcgctcaggcggctcaaaggtcttgacggtggagaacaccatccccagggattcccgacgcggtgatgccatcaaagcgttaattctgagatgggcctgcccgggtgcggactctgccgcactcccttccaggtcaatccaaactggagctcaactttcagaagagaaagacgccccagcaagcctctttcggggagtcctctagctcctcacctccatgggccagacagctctggcagggggcagcagcagcacccccacgccacaggccctgtaccctgacctctcctgtcccgagggcttggaagagctgctgtctgcaccccctcctgacctgggggcccagcggcgccacggttggaaccccaaagactgttcagagaacatcgaggtcaaggaaggagggttgtactttgagcggcggcccgtggcccagagcactgatggggcccggggtaagaggg

SEQ ID NO: 29860 - DNA, 1205 bp, Homo sapiens
cagaggcccggcgacctccagggctgggaagtcaaccgaggttcgggggcagcggcgagggctccgggcgagtcaatccaaactggagctcaactttcagaagagaaagacgccccagcaagcctctttcggggagtcctctagctcctcacctccatgggccagacagctctggcagggggcagcagcagcacccccacgccacaggccctgtaccctgacctctcctgtcccgagggcttggaagagctgctgtctgcaccccctcctgacctgggggcccagcggcgccacggttggaaccccaaagactgttcagagaacatcgaggtcaaggaaggagggttgtactttgagcggcggcccgtggcccagagcactgatggggcccggggtaagaggggctattcaaggggcctgcacgcctgggagatcagctggcccctagagcagaggggcacgcatgccgtggtgggcgtggccacggccctcgccccgctgcagactgaccactacgcggcgctgctgggcagcaacagcgagtcgtggggctgggacatcgggcgggggaagctgtaccatcagagcaaggggcccggagccccccagtatccagcgggaactcagggtgagcagctggaggtgccagagagactgctggtggttctggacatggaggagggaactctgggctacgctattgggggcacctacctggggccagcattccgcggactgaagggcaggaccctctatccggcagtaagcgctgtctggggccagtgccaggtccgcatccgctacctgggcgaaaggagagcggagccacactcccttctgcacctgagccgcctgtgtgtgcgccacaacctgggggatacccggctcggccaggtgtctgccctgcccttgccccctgccatgaagcgctacctgctctaccagtgagccctgtgataccacagactgtgctgaggtcttgccaccacccctccccttggggaggtggggaggcactgctggcctagaccagctgctgaaagctggtgaggctgagcccctaccccaacccaagctctgcggaaatcaacagccccagagccacttggagggaggaagaaagggagccggcgttcaaggctatgacagtctgctacgcaaaacattttttcaagtaaaaatagtaagagatgttgttatagaaa

SEQ ID NO: 29861 - DNA, 1236 bp, Homo sapiens
ggccggcggtctgcgccctgcgcgcctcggcttctttccgcccggctccttcagaggcccggcgacctccagggctgggaagtcaaccgagctcccttccaggtcaatccaaactggagctcaactttcagaagagaaagacgccccagcaagcctctttcggggagtcctctagctcctcacctccatgggccagacagctctggcagggggcagcagcagcacccccacgccacaggccctgtaccctgacctctcctgtcccgagggcttggaagagctgctgtctgcaccccctcctgacctgggggcccagcggcgccacggttggaaccccaaagactgttcagagaacatcgaggtcaaggaaggagggttgtactttgagcggcggcccgtggcccagagcactgatggggcccggggtaagaggggctattcaaggggcctgcacgcctgggagatcagctggcccctagagcagaggggcacgcatgccgtggtgggcgtggccacggccctcgccccgctgcagactgaccactacgcggcgctgctgggcagcaacagcgagtcgtggggctgggacatcgggcgggggaagctgtaccatcagagcaaggggcccggagccccccagtatccagcgggaactcagggtgagcagctggaggtgccagagagactgctggtggttctggacatggaggagggaactctgggctacgctattgggggcacctacctggggccagcattccgcggactgaagggcaggaccctctatccggcagtaagcgctgtctggggccagtgccaggtccgcatccgctacctgggcgaaaggagagcggagccacactcccttctgcacctgagccgcctgtgtgtgcgccacaacctgggggatacccggctcggccaggtgtctgccctgcccttgccccctgccatgaagcgctacctgctctaccagtgagccctgtgataccacagactgtgctgaggtcttgccaccacccctccccttggggaggtggggaggcactgctggcctagaccagctgctgaaagctggtgaggctgagcccctaccccaacccaagctctgcggaaatcaacagccccagagccacttggagggaggaagaaagggagccggcgttcaaggctatgacagtctgctacgcaaaacattttttcaagtaaaaatagtaagagatgttgttatagaaa

SEQ ID NO: 29862 - DNA, 1543 bp, Homo sapiens
gcggggattgtttacgtctcgctccggggcggaaagtgggtcagggccgggccggcggagcgcgcagcgggggctgcagattctttccaccatggccagacgcccccggaacagcagggcctggcacttcgtcctgagtgcagcccgccgagacgcagatgcccgggccgtggctctagcaggctccactaactggggctacgactctgatgggcagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatgatggtgggcatcgggacgtcggatgtggacctggacaaataccgccacacgttctgcagcctgctgggcagggatgaggacagctggggcctctcctacacgggcctcctccaccacaagggcgacaagaccagcttctcatcgcggttcggccagggctccatcattggcgtgcacctggacacctggcacggcacactcacctttttcaagaacaggaagtgtataggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctcaagcaggtgctacacaacaagctgggctgggtcctgagcatgagttgcagccgccgcaaggctccagtgtccgatccccaggcagcgacctccgcccaccccagcagtcgcgagcctcggccctgccagaggaagcgctgccgccggacctgactgacttcccagtggaactgccttcttgggctgggacagcccctttcctctgtcccttctttctctgtcccttccttccagccacactccagggcggagttggatgaggcccgtccggagggagccatctcttgctcccgaggctgggacagtcctttctgtgggggctctagggcccctctgctgctgtgctgggtggggaagcggctgccctgagccccaggtcttgtgggaggctgcgaggacgagagcctggctggagcccgcgttgctgttcccacagggcctcggtttttcctaacttgctctgcatgctgtcagcggctgccccgccgtcatagacttaaaggactgcaataaatgtagagttgatgtctaacaccc

SEQ ID NO: 29863 - DNA, 857 bp, Homo sapiens
atggagtacagctgcggcacagcggccatccggggcaccaaggagctgggggagggccagcacttctgggagatcaagatgacctctcccgtctacggcacactcacctttttcaagaacaggaagtgtataggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctcaagcaggtgctacacaacaagctgggctgggtcctgagcatgagttgcagccgccgcaaggctccagtgtccgatccccaggcagcgacctccgcccaccccagcagtcgcgagcctcggccctgccagaggaagcgctgccgccggacctgactgacttcccagtggaactgccttcttgggctgggacagcccctttcctctgtcccttctttctctgtcccttccttccagccacactccagggcggagttggatgaggcccgtccggagggagccatctcttgctcccgaggctgggacagtcctttctgtgggggctctagggcccctctgctgctgtgctgggtggggaagcggctgccctgagccccaggtcttgtgggaggctgcgaggacgagagcctggctggagcccgcgttgctgttcccacagggcctcggtttttcctaacttgctctgcatgctgtcagcggctgccccgccgtcatagacttaaaggactgcaataaatgtagagttgatgtct

SEQ ID NO: 29864 - DNA, 1784 bp, Homo sapiens
gatgacacggacctactttccggtcaacgcggcctgcggtaccacctcccacccgggtccaatgtgcgcgcgagctttgtctccaaccgcttgggaactgaccaataggaacgttggattaggactgacagttcctgaaacctctcggcaatagctttgtcacccgactcccgccccctctcccgaagctccgagacaggtgtgcccgcccctcgccgccggagccaatgggcgcagggggcggggattgtttacgtctcgctccggggcggaaagtgggtcagggccgggccggcggagcgcgcagcgggggctgcagattctttccaccatggccagacgcccccggaacagcagggcctggcacttcgtcctgagtgcagcccgccgagacgcagatgcccgggccgtggctctagcaggctccactaactggggctacgactctgatgggcagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatgatggtgggcatcgggacgtcggatgtggacctggacaaataccgccacacgttctgcagcctgctgggcagggatgaggacagctggggcctctcctacacgggcctcctccaccacaagggcgacaagaccagcttctcatcgcggttcggccagggctccatcattggcgtgcacctggacacctggcacggcacactcacctttttcaagaacaggaagtgtataggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctcaagcaggtgctacacaacaagctgggctgggtcctgagcatgagttgcagccgccgcaaggctccagtgtccgatccccaggcagcgacctccgcccaccccagcagtcgcgagcctcggccctgccagaggaagcgctgccgccggacctgactgacttcccagtggaactgccttcttgggctgggacagcccctttcctctgtcccttctttctctgtcccttccttccagccacactccagggcggagttggatgaggcccgtccggagggagccatctcttgctcccgaggctgggacagtcctttctgtgggggctctagggcccctctgctgctgtgctgggtggggaagcggctgccctgagccccaggtcttgtgggaggctgcgaggacgagagcctggctggagcccgcgttgctgttcccacagggcctcggtttttcctaacttgctctgcatgctgtcagcggctgccccgccgtcatagacttaaaggactgcaataaatgtagagttgatgtctaacaccca

SEQ ID NO: 29865 - DNA, 2908 bp, Homo sapiens
cggcggcggaggagggggaggcggcggcggctgcagcatccagagctggccgtggcggccggcgcgccccgcgcacaaaagcacccagccccaggggagggcgatgaacacaccacatcccgggcccgggccccagctgctgctaccgctgcgtgcgctcagggcgctggggaagacgcccggcgcgccgggggccagcggccgaggcgcggcccgtgcgccctgagcgcgggactcgtcgccctccgggtcaggcgccaagcttccaagcggctagagcgcgggccttggagcgcccccaggatcgcttcagtaaggcgcttccccactccaggcccgacccccggcgcctgagcgccaacttcgccaagaacgctcctaactccaggccatcctgcagcgcagagggggcgctgctgccgggcatcagccgtgaggacgcgcccctggccgtgcggagagagccggcatttgcgggtcactcgggcgcccctgagtgggcggcggcggcagcagacccctctccagggagtccaggacctgccagcgctggggattcttcccgaacaggcgcttgccctctcttttatggagcttgggcccctgccgcagcccggtagaggctgtggaggtctaccgtccggaagcctggttcccagccccgtggcccattcctggctacggggagtggaggctcccacgaggtagcggtggcctgcagcggcctcctccccgcagtgaagcatgggccagaagctctcggggagcctcaagtcagtggaggtgcgagagccggcgctgcggccggccaagcgggagctgcggggtgcagagcccgggcggccggcgcggctggaccagctgttggacatgccagcggcggggctggctgtgcagctgcggcacgcgtggaaccccgaggaccgctcgctcaacgtcttcgtcaaggacgacgaccggctcaccttccaccggcaccccgtggcccagagcaccgacggcatccgcggcaaggtgggccacgcccgcggcctgcacgcctggcagatcaactggccggctcggcagcgcggcacccacgctgtagttggtgtggccacggcccgtgctcccctgcactccgtgggctacacggcgctggtaggcagtgacgccgagtcgtggggctgggacctgggccgcagccgcctctaccacgacggcaagaaccagcccggcgtggcctacccggcctttctggggcccgacgaggcctttgcgctgcccgactcgctgctcgtggtgctggacatggatgagggcacactcagcttcatcgtggatggccagtacctgggcgtggccttccgaggtctcaagggcaagaagctgtacccggtggtgagtgccgtgtggggccactgtgaagtcaccatgcgctacatcaacggccttgaccccgagcccctgccactgatggacctgtgccggagatccatccgctcggccctgggccgccagcgcctgcaggacatcagctccctgcccctgcctcagtctctcaaaaactatctgcagtaccagtgagccaagcctgatgggcagcacagacacagacacacaccgcagggcccgaccctcctgtcattcacagtcccatggcacataggggaaaggatctacccttctcctggctccccaggacactcagttctttcaaagaccaggatgtggtaccaactttggaaacgaaaggtctcttgccaacagtatctactgccctcgaggcagccctcccaagtcagacacctccttcggagccacagagagcctggagtctgcacctcctggaaatcctgccaccaaccaggacacagcagccaccgtattgatcagagagcctgtttccttattcaagagaatgaataaaacatttaggcaggagactttctattgtgtgccccgttgcagacagggccagggagaaattagccagtgcagggggaaaattgcctctgaataatgaatgatgaaagcctgacgccgtgcccctcctggcccatacgccttgccagggcggcaggattgtcacaccgttttaggactctgtgccactttgagagactgttcccaggaggcccaaccgcagacctggcaagtggacagtgcagtgtggagacaccttccggcttacctctttgaacgttgtttacctacccctttccacgtgctccccttcccagccactgactcacagttctctggatgcccagacacctctcttcagggaagatgagtctgactggtttgccccagggaagagcatatccttaccattattttaagtagcatttgcattttaaaagaggaatgcggagaggacagtacttagtccaaaggtgctaacgggggaactgggggcattgtgacacccaagtctgatgtgtcctgggttggggggccttcctggagtgtcagggtctctgggcaacgtccattcagggtgcggcatggctgtcacaaagctttatttgagcaaattattttttcactttaggagacttctacaagtttgtttcctgtttcaaatgtgtgtgtgatgtgctgtttatttatcagcttgaggtccatgggggcagccttgtgactggaagggtggatatgggagacacattctctacctgctccgagcctggtcctctcgcaggaatgctgctgctgcctccgccgccactgctgctgccacctcttatatgtttcagacactctctgcccagactcatttttaactggaaatcatcacagcagtgggatatcagagccccagacagcactgcctcttcctccccaccccactgcccccaccttaatgtgaatttgactgatgaatgaagagcgtttctaataaagtttgtcattcagtccttca

SEQ ID NO: 29866 - DNA, 4990 bp, Homo sapiens
tcctctcagatttgtgtgcttcttcccttcccacattctatactgcccagcgcctgggattccagatctgcgtttgaatccaggaaagggaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgacttggtcagcgggtggaataatctcaagaatcaaatcatactccttcccaaagcctggccacagaaagtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttg

SEQ ID NO: 29867 - DNA, 4908 bp, Homo sapiens
ctttctggtaaggagaggaggttacggggaacgacgcgctgctttcatgccctttcttgttctaccttcatcggccgaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttg

SEQ ID NO: 29868 - DNA, 4936 bp, Homo sapiens
gaggaagagccgcgggcccggcggctgaggccaccccggcggcggctggagagcgaggaggagcgggtggccccgcgctgcgcccgccctcgcctcacctggcgcaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttg

SEQ ID NO: 29869 - DNA, 5005 bp, Homo sapiens
gaggaagagccgcgggcccggcggctgaggccaccccggcggcggctggagagcgaggaggagcgggtggccccgcgctgcgcccgccctcgcctcacctggcgcaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgacttggtcagcgggtggaataatctcaagaatcaaatcatactccttcccaaagcctggccacagaaagtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttg

SEQ ID NO: 29870 - DNA, 2850 bp, Homo sapiens
gcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaagatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaagatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 29871 - DNA, 3094 bp, Homo sapiens
cggagctcagttcacgcagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaagatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 29872 - DNA, 3470 bp, Homo sapiens
accgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaagatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 29873 - DNA, 2854 bp, Homo sapiens
gcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatgggtaaatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaagatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaagatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 29874 - DNA, 2309 bp, Homo sapiens
agtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatataggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaagatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaagatgtttgtttaaag

SEQ ID NO: 29875 - DNA, 2947 bp, Homo sapiens
cctccccccgggaggcttgcgaaggagaagccgccgcagaggaaaagcaggtgccggtgcctgtccccgggggcgccatggcgaccggagcgaacgccacgccgttgggtaagctgggcccccccgggctgcccccgctccccgggcccaaaggaggcttcgagccgggccctccgcctgcacccgggcctggggcggggctgctggctcccgggccgccgccgcccccgcccgtgggctcgatgggggccctgaccgcggccttccccttcgcggcgctgcctccgccgcctccgccgccgccccctccgcctccccagcagccgccgccgcctccaccgccaccgtcccccggcgcctcgtacccgccgccgcagccgccccctccgccgccgctctaccagcgcgtgtcgccgccgcagccgccgccaccccagccgccgcgtaaggaccagcagccgggcccggccggcggcggaggagacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaagatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaagatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 29876 - DNA, 2317 bp, Homo sapiens
gacgcagtgaggtggccgggctgtgcggcgcaactgtatagactgggggcccactattgctgtccagtccgctggtgtcgggaacaggggtggcgggtgttcagcgctggacggggtgctagctgtgaatgccagcagggcgtgaaagcctcacctgatgacgtgcagcgactcccttctggtcttgaggaaccagaatgggaaccgtaccaaggatagctcctctgcttctacagcaaggcagggttttcatccgggagagacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattc

SEQ ID NO: 29877 - DNA, 3510 bp, Homo sapiens
ggtcccggaagtgcgccagtcgtaccttcgcggccgcaactcgctcggccgccgccatcttgcgagctcgtcgtactgaccgagcggggaggctgtcttgaggcggcaccgctcaccgacaccgaggcggactggcagccctgagcgtcgcagtcatgccggccggacccgtgcaggcggtgcccccgccgccgcccgtgcccacggagcccaaacagcccacagaagaagaagcatcttcaaaggaggattctgcaccttctaagccagttgtggggattatttaccctcctccagaggtcagaaatattgttgacaagactgccagctttgtggccagaaacgggcctgaatttgaagctaggatccgacagaacgagatcaacaaccccaagttcaactttctgaaccccaatgacccttaccatgcctactaccgccacaaggtcagcgagttcaaggaagggaaggctcaggagccgtccgccgccatccccaaggtcatgcagcagcagcagcagaccacccagcagcagctgccccagaaggtccaagcccaagtaatccaagagaccatcgtgcccaaagagcctcctcctgagtttgagttcattgctgatcctccctctatctcagccttcgacttggatgtggtgaagctgacggctcagtttgtggccaggaatgggcgccagtttctgacccagctgatgcagaaagagcagcgcaactaccagtttgactttctccgcccacagcacagcctcttcaactacttcacgaagctagtggaacagtacaccaagatcttgattccacccaaaggtttattttcaaagctcaagaaagaggctgaaaacccccgagaagttttggatcaggtgtgttaccgagtggaatgggccaaattccaggaacgtgagaggaagaaggaagaagaggagaaggagaaggagcgggtggcctatgctcagatcgactggcatgattttgtggtggtggaaacagtggacttccaacccaatgagcaagggaacttccctccccccaccacgccagaggagctgggggcccgaatcctcattcaggagcgctatgaaaagtttggggagagtgaggaagttgagatggaggtcgagtctgatgaggaggatgacaaacaggagaaggcggaggagcctccttcccagctggaccaggacacccaagtacaagatatggatgagggttcagatgatgaagaagaagggcagaaagtgcccccacccccagagacacccatgcctccacctctgcccccaactccagaccaagtcattgtccgcaaggattatgatcccaaagcctccaagcccttgcctccagcccctgctccagatgagtatcttgtgtcccccattactggggagaagatccccgccagcaaaatgcaggaacacatgcgcattggacttcttgaccctcgctggctggagcagcgggatcgctccatccgtgagaagcagagcgatgatgaggtgtacgcaccaggtctggatattgagagcagcttgaagcagttggctgagcggcgtactgacatcttcggtgtagaggaaacagccattggtaagaagatcggtgaggaggagatccagaagccagaggaaaaggtgacctgggatggccactcaggcagcatggcccggacccagcaggctgcccaggccaacatcaccctccaggagcagattgaggccattcacaaggccaaaggcctggtgccagaggatgacactaaagagaagattggccccagcaagcccaatgaaatccctcaacagccaccgccaccatcttcagccaccaacatccccagctcggctccacccatcacttcagtgccccgaccacccacaatgccacctccagttcgtactacagttgtctccgcagtacccgtcatgccccggcccccaatggcatctgtggtccggctgcccccaggctcagtgatcgcccccatgccgcccatcatccacgcgcccagaatcaacgtggtgcccatgcctccctcggcccctcctattatggccccccgcccaccccccatgattgtgccaacagcctttgtgcctgctccacctgtggcacctgtcccagctccagccccaatgccccctgtgcatcccccacctcccatggaagatgagcccacctccaaaaaactgaagacagaggacagcctcatgccagaggaggagttcctgcgcagaaacaagggtccagtgtccatcaaagtccaggtgcccaacatgcaggataagacggaatggaaactgaatgggcaggtgctggtcttcaccctcccactcacggaccaggtctctgtcattaaggtgaagattcatgaagccacaggcatgcctgcagggaaacagaagctacagtatgagggtatcttcatcaaagattccaactcactggcttactacaacatggccaatggcgcagtcatccacctggccctcaaggagagaggcgggaggaagaagtagacaagaggaacctgctgtcaagtccctgccattttgcctctcctgtctcccaccccctgccccagacccaggagcccccctgaggctttgccttgcctgcatatttgtttcgctcttactcagtttgggaattcaaattgtcctgcagaggttcattcccctgaccctttccccacattggtaagagtagctgggttttctaagccactctctggaatctctttgtgttagggtctcgatttgaggacattcatttcttcagcagcccattagcaactgagagcccagggatgtcctacaggatagtttcatagtgacaggtggcacttggctaatagaatatggctgatattgtcattaatcattttgtaccttgacatgggttgtctaataaaactcggacccttcttgtgaaatcagttaaataagacttgtctcggtcacctgtgccctgtccagactcgaggcagtggtaacactgcacagtgctatgtggcttctctttgaggatttttgggttttgtaactaaattcttgctgccctcatactttttatgtattagaatcatattcgtattgcccttttaaaacattgggatcctccaaaggcctgccccatgtatttaacagtaatacaggaagcatggcaggcaccatgcaaaccaaggatggatggtgcagtccctgtgtcagtgggcggtggtttcctgctggcctggaatcactcatcacctgattgattggctctgtggtcctgggcaggtgcctcataggtgtgtggatatgatgacgtttctttaaaatgtatgtatttaacaaatacttaattgtattaaggtcatgtaccaaggatttgataaagtttaaataatttactctctacttttatccattttatccattttaactcatgtaatcctcatgtgagtattcctgtttaacacttgagtaaactgaggcacagagaacataa

SEQ ID NO: 29878 - DNA, 4923 bp, Homo sapiens
accttcgcggccgcaactcgctcggccgccgccatcttgcgagctcgtcgtactgaccgagcggggaggctgtcttgaggcggcaccgctcaccgacaccgaggcggactggcagccctgagcgtcgcagtcatgccggccggacccgtgcaggcggtgcccccgccgccgcccgtgcccacggagcccaaacagcccacagaagaagaagcatcttcaaaggaggattctgcaccttctaagccagttgtggggattatttaccctcctccagaggtcagaaatattgttgacaagactgccagctttgtggccagaaacgggcctgaatttgaagctaggatccgacagaacgagatcaacaaccccaagttcaactttctgaaccccaatgacccttaccatgcctactaccgccacaaggtcagcgagttcaaggaagggaaggctcagtttgtggccaggaatgggcgccagtttctgacccagctgatgcagaaagagcagcgcaactaccagtttgactttctccgcccacagcacagcctcttcaactacttcacgaagctagtggaacagtacaccaagatcttgattccacccaaaggtttattttcaaagctcaagaaagaggctgaaaacccccgagaagttttggatcaggtgtgttaccgagtggaatgggccaaattccaggaacgtgagaggaagaaggaagaagaggagaaggagaaggagcgggtggcctatgctcagatcgactggcatgattttgtggtggtggaaacagtggacttccaacccaatgagcaagggaacttccctccccccaccacgccagaggagctgggggcccgaatcctcattcaggagcgctatgaaaagtttggggagagtgaggaagttgagatggaggtcgagtctgatgaggaggatgacaaacaggagaaggcggaggagcctccttcccagctggaccaggacacccaagtacaagatatggatgagggttcagatgatgaagaagaagggcagaaagtgcccccacccccagagacacccatgcctccacctctgcccccaactccagaccaagtcattgtccgcaaggattatgatcccaaagcctccaagcccttgcctccagcccctgctccagatgagtatcttgtgtcccccattactggggagaagatccccgccagcaaaatgcaggaacacatgcgcattggacttcttgaccctcgctggctggagcagcgggatcgctccatccgtgagaagcagagcgatgatgaggtgtacgcaccaggtctggatattgagagcagcttgaagcagttggctgagcggcgtactgacatcttcggtgtagaggaaacagccattggtaagaagatcggtgaggaggagatccagaagccagaggaaaaggtgacctgggatggccactcaggcagcatggcccggacccagcaggctgcccaggccaacatcaccctccaggagcagattgaggccattcacaaggccaaaggcctggtgccagaggatgacactaaagagaagattggccccagcaagcccaatgaaatccctcaacagccaccgccaccatcttcagccaccaacatccccagctcggctccacccatcacttcagtgccccgaccacccacaatgccacctccagttcgtactacagttgtctccgcagtacccgtcatgccccggcccccaatggcatctgtggtccggctgcccccaggctcagtgatcgcccccatgccgcccatcatccacgcgcccagaatcaacgtggtgcccatgcctccctcggcccctcctattatggccccccgcccaccccccatgattgtgccaacagcctttgtgcctgctccacctgtggcacctgtcccagctccagccccaatgccccctgtgcatcccccacctcccatggaagatgagcccacctccaaaaaactgaagacagaggacagcctcatgccagaggaggagttcctgcgcagaaacaagggtccagtgtccatcaaagtccaggtgcccaacatgcaggataagacggaatggaaactgaatgggcaggtgctggtcttcaccctcccactcacggaccaggtctctgtcattaaggtgaagattcatgaagccacaggcatgcctgcagggaaacagaagctacagtatgagggtatcttcatcaaagattccaactcactggcttactacaacatggccaatggcgcagtcatccacctggccctcaaggagagaggcgggaggaagaagtagacaagaggaacctgctgtcaagtccctgccattttgcctctcctgtctcccaccccctgccccagacccaggagcccccctgaggctttgccttgcctgcatatttgtttcgctcttactcagtttgggaattcaaattgtcctgcagaggttcattcccctgaccctttccccacattggtaagagtagctgggttttctaagccactctctggaatctctttgtgttagggtctcgatttgaggacattcatttcttcagcagcccattagcaactgagagcccagggatgtcctacaggatagtttcatagtgacaggtggcacttggctaatagaatatggctgatattgtcattaatcattttgtaccttgacatgggttgtctaataaaactcggacccttcttgtgaaatcagttaaataagacttgtctcggtcacctgtgccctgtccagactcgaggcagtggtaacactgcacagtgctatgtggcttctctttgaggatttttgggttttgtaactaaattcttgctgccctcatactttttatgtattagaatcatattcgtattgcccttttaaaacattgggatcctccaaaggcctgccccatgtatttaacagtaatacaggaagcatggcaggcaccatgcaaaccaaggatggatggtgcagtccctgtgtcagtgggcggtggtttcctgctggcctggaatcactcatcacctgattgattggctctgtggtcctgggcaggtgcctcataggtgtgtggatatgatgacgtttctttaaaatgtatgtatttaacaaatacttaattgtattaaggtcatgtaccaaggatttgataaagtttaaataatttactctctacttttatccattttatccattttaactcatgtaatcctcatgtgagtattcctgtttaacacttgagtaaactgaggcacagagaacataagttgcatgccatagtcacacactgtgaaagtgaaaagagaatgtgtgcaaaacacgtcacagtcctggtttctgagtaaaggcaggctgttatctttagaatcaagctatcacagggagataggcaatgctgtgggtgttggaggaaggtgagagcctgttgctaacaatttcctggttttaaagctaaggctgattttattgggaagatctcacatgtgtgtggcccctgagagttcccagtgccttttatttgcagtccttccatttggacctcctagctgccccatcaggtcatctccagggctcagaggggtgagaccatttcccaaggtcacagaaccagctctctagtcaccaccctgcctctccctctcacccagagtcagtaccagttttatggctttattacaaactgctgggtccctcccattttcaacttgattgatgggatgtcatcccttatcctgtctgacatttgcctctggcctggttgctagaagtttgccccaggggcaagagttgaaatttggcttcctgaggtgggctttgtggtttgcgtccctaaagtgagcccactactggttgcttgtccatggccaacaccagaaatcccctgagcactacctgggtctcattccaagaaggaagagggtcaggagacctggggagtctcatattccaagttcttctttctttctgggagcagtgggcagttcatggtgttagggcactcacccccacagactggcaaaccctgcaggacttccgtggctgaggctgtgaccggaggccaggaatgccgttgggtggattgtgagtgaatgggccctttgagctgccctctagagagcaaatccagtttcctggagctcctgaatgaatatctgtactggctcgctcagatgcagaagctccattgaccatgaggccttgtgaacatcagtggccacaggcccagtgtgctgcttggcactgcactagtttaggacctgcagcatgtaggtagcgtcctagtgtttataatacaaagctgctctgcacagcttttctgattcttcttgcaatctcctgaggattatctgccccatttttaaaacgaggtggaatacccaaggtcatgtagccagtgagtgctctggaaagccaaagcagctcatcccttcctggggaccacactgctctgctccaccagaccacactatgaaataggaataagtgctcctgttgcaggactgctgggaaaacaggtggtgtgggacttaagtcaccataattttgaagacttgcatgcagagggctccaggaattgtagacattaaggaatttcactttcagttctacccactacttaagtacttgtcatgtactcttagaggaggccagtaatgatcagaaccattttactttaaaattaataatattgtattagagaatatattaaatggttatattgggttatgttaggatatatacttgaatggaaatacatgtactattagcaatcatatttcatttatccctgtaattagacaagaaagcataatatagctctactcatgggtacacataccagtgtataagatttttagaagtttactttttaaaaataaaagcaaaatgtaagatctt

SEQ ID NO: 29879 - DNA, 2920 bp, Homo sapiens
cttcgcggccgcaactcgctcggccgccgccatcttgcgagctcgtcgtactgaccgagcggggaggctgtcttgaggcggcaccgctcaccgacaccgaggcggactggcagccctgagcgtcgcagtcatgccggccggacccgtgcaggcggtgcccccgccgccgcccgtgcccacggagcccaaacagcccacagaagaagaagcatcttcaaaggaggattctgcaccttctaagccagttgtggggattatttaccctcctccagaggtcagaaatattgttgacaagactgccagctttgtggccagaaacgggcctgaatttgaagctaggatccgacagaacgagatcaacaaccccaagttcaactttctgaaccccaatgacccttaccatgcctactaccgccatccccaaggtcatgcagcagcagcagcagaccacccagcagcagctgccccagaaggtccaagcccaagtaatccaagagaccatcgtgcccaaagagcctcctcctgagtttgagttcattgctgatcctccctctatctcagccttcgacttggatgtggtgaagctgacggctcagtttgtggccaggaatgggcgccagtttctgacccagctgatgcagaaagagcagcgcaactaccagtttgactttctccgcccacagcacagcctcttcaactacttcacgaagctagtggaacagtacaccaagatcttgattccacccaaaggtttattttcaaagctcaagaaagaggctgaaaacccccgagaagttttggatcaggtgtgttaccgagtggaatgggccaaattccaggaacgtgagaggaagaaggaagaagaggagaaggagaaggagcgggtggcctatgctcagatcgactggcatgattttgtggtggtggaaacagtggacttccaacccaatgagcaagggaacttccctccccccaccacgccagaggagctgggggcccgaatcctcattcaggagcgctatgaaaagtttggggagagtgaggaagttgagatggaggtcgagtctgatgaggaggatgacaaacaggagaaggcggaggagcctccttcccagctggaccaggacacccaagtacaagatatggatgagggttcagatgatgaagaagaagggcagaaagtgcccccacccccagagacacccatgcctccacctctgcccccaactccagaccaagtcattgtccgcaaggattatgatcccaaagcctccaagcccttgcctccagcccctgctccagatgagtatcttgtgtcccccattactggggagaagatccccgccagcaaaatgcaggaacacatgcgcattggacttcttgaccctcgctggctggagcagcgggatcgctccatccgtgagaagcagagcgatgatgaggtgtacgcaccaggtctggatattgagagcagcttgaagcagttggctgagcggcgtactgacatcttcggtgtagaggaaacagccattggtaagaagatcggtgaggaggagatccagaagccagaggaaaaggtgacctgggatggccactcaggcagcatggcccggacccagcaggctgcccaggccaacatcaccctccaggagcagattgaggccattcacaaggccaaaggcctggtgccagaggatgacactaaagagaagattggccccagcaagcccaatgaaatccctcaacagccaccgccaccatcttcagccaccaacatccccagctcggctccacccatcacttcagtgccccgaccacccacaatgccacctccagttcgtactacagttgtctccgcagtacccgtcatgccccggcccccaatggcatctgtggtccggctgcccccaggctcagtgatcgcccccatgccgcccatcatccacgcgcccagaatcaacgtggtgcccatgcctccctcggcccctcctattatggccccccgcccaccccccatgattgtgccaacagcctttgtgcctgctccacctgtggcacctgtcccagctccagccccaatgccccctgtgcatcccccacctcccatggaagatgagcccacctccaaaaaactgaagacagaggacagcctcatgccagaggaggagttcctgcgcagaaacaagggtccagtgtccatcaaagtccaggtgcccaacatgcaggataagacggaatggaaactgaatgggcaggtgctggtcttcaccctcccactcacggaccaggtctctgtcattaaggtgaagattcatgaagccacaggcatgcctgcagggaaacagaagctacagtatgagggtatcttcatcaaagattccaactcactggcttactacaacatggccaatggcgcagtcatccacctggccctcaaggagagaggcgggaggaagaagtagacaagaggaacctgctgtcaagtccctgccattttgcctctcctgtctcccaccccctgccccagacccaggagcccccctgaggctttgccttgcctgcatatttgtttcgctcttactcagtttgggaattcaaattgtcctgcagaggttcattcccctgaccctttccccacattggtaagagtagctgggttttctaagccactctctggaatctctttgtgttagggtctcgatttgaggacattcatttcttcagcagcccattagcaactgagagcccagggatgtcctacaggatagtttcatagtgacaggtggcacttggctaatagaatatggctgatattgtcattaatcattttgtaccttgacatgggttgtctaataaaactcggacccttcttgtgaaatcagttaaataagacttgtctcggtcacctgtgccctgtcca

SEQ ID NO: 29880 - DNA, 1649 bp, Homo sapiens
ggaagtgctttctttgcccgccgttcgccaaacgaagtcgtggaggtggcgaaacgaggaggagataacgcggccttgggctctggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccccagctcctggagtccaccctccagcccccggggttcacccaccagcccccggagtccacccaccagcccctggggttcacccaccagccccaggggtccatcctcccccatcagcgggggttcacccccaggccccgggggtgcacccagcagcccccgccgttcaccctcaggccccaggggtgcacccaccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactgatgtccgc

SEQ ID NO: 29881 - DNA, 4336 bp, Homo sapiens
agtgcagcccccagctatttttctccgtggcggcggcgacgagcggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggagggaaaacccctgatcctaaaatgaatgctaggacttacatggatgtaatgcgagaacaacacttgactaaagaagaacgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagagacccctgggcatactccttccttaagatgggatgagacaccaggtcgtgcaaagggaagcgagactcctggagcaaccccaggctcaaaaatatgggatcctacacctagccacacaccagcgggagctgctactcctggacgaggtgatacaccaggccatgcgacaccaggccatggaggcgcaacttccagtgctcgtaaaaacagatgggatgaaacccccaaaacagagagagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtgggaaagagaaattgatgagagaaatcgcccactttctgatgaggaattagatgctatgttcccagaaggatataaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggttgatgttgatgaatcaacacttagtccagaagagcaaaaagagagaaaaataatgaagttgcttttaaaaattaagaatggaacaccaccaatgagaaaggctgcattgcgtcagattactgataaagctcgtgaatttggagctggtcctttgtttaatcagattcttcctctgctgatgtctcctacacttgaggatcaagagcgtcatttacttgtgaaagttattgataggatactgtacaaacttgatgacttagttcgtccatatgtgcataagatcctcgtggtcattgaaccgctattgattgatgaagattactatgctagagtggaaggccgagagatcatttctaatttggcaaaggctgctggtctggctactatgatctctaccatgagacctgatatagataacatggatgagtatgtccgtaacacaacagctagagcttttgctgttgtagcctctgccctgggcattccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtcttgtggatgagcagcagaaagttcggaccatcagtgctttggccattgctgccttggctgaagcagcaactccttatggtatcgaatcttttgattctgtgttaaagcctttatggaagggtatccgccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtggtaaaacagtgttgtgggacagatggtgtagaagcaaactacattaaaacagagattcttcctcccttttttaaacacttctggcagcacaggatggctttggatagaagaaattaccgacagttagttgatactactgtggagttggcaaacaaagtaggtgcagcagaaattatatccaggattgtggatgatctgaaagatgaagccgaacagtacagaaaaatggtgatggagacaattgagaaaattatgggtaatttgggagcagcagatattgatcataaacttgaagaacaactgattgatggtattctttatgctttccaagaacagactacagaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggaaaaattgatgggacacttgggtgttgtattgtatgagtatttgggtgaagagtaccctgaagtattgggcagcattcttggagcactgaaggccattgtaaatgtcataggtatgcataagatgactccaccaattaaagatctgctgcctagactcacccccatcttaaagaacagacatgaaaaagtacaagagaattgtattgatcttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtatttgagacatctcctcatgtaattcaggcagttatgggagccctagagggcctgagagttgctattggaccatgtagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgctaa

SEQ ID NO: 29882 - DNA, 600 bp, Homo sapiens
gttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggcttctattctgctgcttgaagtcagaactgctgatggagacaaaggcacgaaagtgagggaaaacccctgatcctaaaatgaatgctaggacttacatggatgtaatgcgagaacaacacttgactaaagaagaacgagaaattaggcaacagcta

SEQ ID NO: 29883 - DNA, 651 bp, Homo sapiens
agctatttttctccgtggcggcggcgacgagcggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggcttctattctgctgcttgaagtcagaactgctgatggagacaaaggcacgaaagtgtacgtattccggattagcaacccaggaacccatcacttctgaagactctaaactgtgctgtcattttgtttttatatgcattaaaatatttgttttaaa

SEQ ID NO: 29884 - DNA, 2903 bp, Homo sapiens
gaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccacccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaagagatgaatatttaacact

SEQ ID NO: 29885 - DNA, 2553 bp, Homo sapiens
gctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccacccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagggagatcattcgctgaaggaacatgagctcttggagcagcagaagcgggcagctgtgttactggagcaggaacgacagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaagagatg

SEQ ID NO: 29886 - DNA, 6969 bp, Homo sapiens
gcctttttccgccgcgcgccaccagaatgtccctgtcttgaggtctaatggcggacgccagtatgttggagttggtggtggcttaagttttgaagggaggtagcatccgttggatatccacaccatccttctcgctgcaggctttcttggactccgtactgttggtgtaaccaaggcctggaggtctgggtggctcaggtttcctgcagccatgtttctgtacaacttaaccttgcagagagccactggcatcagctttgccattcatggaaacttttctggaaccaaacaacaagaaattgttgtttcccgtgggaagatcttggagctgcttcgcccagaccccaacactggcaaagtacataccctactcactgtggaagtattcggtgttatccggtcactcatggcctttaggctgacaggtggcaccaaagactacattgtagttggcagtgactctggtcgaattgttattttggaataccagccatctaagaatatgtttgagaagattcaccaagaaacctttggcaagagtggatgccgtcgcatcgttcctggccagttcttagctgtggatcccaaagggcgagccgttatgattagtgccattgagaaacagaaattggtgtatattttgaacagagatgctgcagcccgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgatctgctctgaaaactatattacttacaagaactttggtgaccagccagatatccgctgtccaattcccaggaggcggaatgacctggatgaccctgaaagaggaatgatttttgtctgctctgcaacccataaaaccaaatcgatgttcttctttttggctcaaactgagcagggagatatctttaagatcactttggagacagatgaagatatggttactgagatccggctcaaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacagaacggtgtgctgctgaggactgtcttggaccctgtcactggggatttgtctgatactcgcactcggtacctggggtcccgtcctgtgaagctcttccgagtccgaatgcaaggccaggaggcagtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtgactggcatccatgtgtcttgttctggagatgaggatgtaggtgggaggtttgaacccaagttagagcaggaagaactgagtagactccttccttccagataccgacttggacttgcggcactctgtggctccccacccccaggtctgtggtggtttctttgttttttcctggttctttttgctgtgctgatgaaacatgacctcaataaccatgtgtatacccacccctcttcccactgggtattgaggaagggtggctgattcttcctcctcttctactctgaggatgttagtatggggattttagcatgaattctagctggggagtcttaacagatgccccttttactgatacagcacctaaagcgatctttggctccataggaccataggaagggtcagtacagaagaacctagatactgccctgcccctgagaactgtgtatatgtggggcctgtctgcagcacccatctcaggtgggttccagagggcctttagggtataatgagagcctgttaggtggaagaggcccagttccagaaatgttccagcccacccctgagaattcctcctgtttagttgtgtgggaagccctcgtcttccaggctgtccttgcgccttgaacctggagaagtgagctcactgttctcaatacttcacaaatgtaaaactttctttcgtctgcatgtgctcagccatctaaattgagcaaatgatctggtgagcactgggttagaatcaggaatggtggaatacaatctgaacctctcagagcccagaacagagggttcctgacactgtgacactgtctcctggaactaagtatctcttgaatcatgacttggttttagatcagtcaagagagacccaggttttgccaggaatcgaatccctaaataacatgtttttttctcacttagctcatgaatttgcatagtagacagtagttctgaattagattttgaaaacctaatttcagggctcattttttcctgtggccctaaatccattctatcaaattgtgtgatactgacatgcagtcatctgaggaactcagcgtagatacttgagcagctcctcgcctcttttctaactcaagtttgactaaaatacatacactccgtacagaaggtagggggttatgtaagaaaggaaaacctaatctatggaatcaggagttgtcaccaccgagcttcctctggaagtctgcccatcagcttgcttgttctctgttaagaggaagggctaggacaaggatttgggcttgaatatgtggaaaggaattttcatagttgttgctgcaggacctacaaaagtttaaaattagattggatgtgactcaatgacaagtcccatctgtgtaattgttaaggggacctgattgactcctgtggtttgattgagcaaccaggtaaatagagacctctctccagctttggcaaaacccatcagaggctgctgcagaactcagacagagggatctgcccttgggtttgcttccatcctgttccattgctaagcccttgtgacttggatcctaggactgaaaagtttttagctgcctcagctttcccctgaccttactggcagaggttctgcagatgtttcctttggaagatctcttgccaagaatagcattcctttggaggaggggggttctagttggaatgttgcttttcttggttagtgtaaatgtattgctagtgagacagctgccggcgctggaaaaggctcgtctcacagggagagtgctggtccccagaatgtgtgctgttcccacgctgctgcctttcttgagcttgttagaggaaagccagaaaggcattcagatgggatcagtctggctttcaaattttttttaattcctaagttctgttttattttttaattttttaaaaaaaattttattagagacagtctctctctcttgcctagctgggagtgcagtggagtgatcatagctcactgaggcttgaactcctgggctcgagcaatccacctcagcctccagagtaggggagactacagatgtgtgccaccatactcagctaatttttaaacttttgtagagacagggtctccctgtgttgcccaggctggcctcgaactcctgacctcaaaaaatcttcctgccttggcctcccaaagcactgggattataggtgtgagccattgcgcctggtcataaattcttgtttttttgtttgtttgtttattagagatggaatctctctctcttgaccaggctagagggctgtggtgcgatctcagcccactgcaacctctatctcctgagctcaagcgatcctccttagcttcccaaatagctggaactacaggcatgtgccatcacgtccagctaatttttgtatttttagtagagaaggttttaccatgttggacagggtggtctcgaactcctggcctaaagtggtccacctagctcagcctaccaaagtgctgtgattacaggcgtgagccaccatgcccagcctctaaattctgttttctattcaaagtaaaaatgacatgtgtttgagtcatccacttgctcatttgcatatggaatattgtatgtgaatattttattacacccttaaaattaattttcaagggcta

SEQ ID NO: 29887 - DNA, 984 bp, Homo sapiens
cgccagtatgttggagttggtggtggcttaagttttgaagggaggtagcatccgttggatatccacaccatccttctcgctgcaggctttcttggactccgtactgttggtgtaaccaaggcctggaggtctgggtggctcaggtttcctgcagccatgtttctgtacaacttaaccttgcagagagccactggcatcagctttgccattcatggaaacttttctggaaccaaacaacaagaaattgttgtttcccgtgggaagatcttggagctgcttcgcccagaccccaacactggcaaagtacataccctactcactgtggaagtattcggtgttatccggtcactcatggcctttaggctgacaggtggcaccaaagactacattgtagttggcagtgactctggtcgaattgttattttggaataccagccatctaagaatatgtttgagaagattcaccaagaaacctttggcaagagtggatgccgtcgcatcgttcctggccagttcttagctgtggatcccaaagggcgagccgttatgattagtgccattgagaaacagaaattggtgtatattttgaacagagatgctgcagcccgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgaacctgagtcccccattccccaaagccatccctgcattgatatgtcttgactctcctgtctacttttgcacacacccttaa

SEQ ID NO: 29888 - DNA, 2085 bp, Homo sapiens
atgcaattaggacgaggtgagcgcagacgtcactctaagctcagacatttcgcagtctcctcccctgagggaaaaccaaatacctccagcccaaatcagggttgtgaggccaaatctgcaagaaggctgcaggcgagagggaaggctccctctgcgcctgaaagcccccaagtcctcgggttggggggaactcttcagcacatccttctctggacaacagaagaagaatcactgtccacaaaatatattaaaactgaaatttttgttcttttagctttcgaatttacacttttgagagcagtgtgattctttcaagtctagcagtgcattaagagggcctgagcgtttccgttccgccctcctcgctaagacaactagcagcggcacctcaggacgcgagccgaggactctaccgcccgacccaggttaagtttcggaggctcctaagatggctgcagccgcttccaggcacctcctcttccgcggccccgcccaccgctacgtccgtcttcgccccggaagtggaagtcgtgctgaggtcagaaggcggaaccgctgctgggagacggcgggatctctttcgccatggctgccgggccgatctccgagcggaatcaggatgccactgtgtacgtggggggcctggatgagaaggttagtgaaccgctgctgtgggaactgtttctccaggctggaccagtagtcaacacccacatgccaaaggatagagtcactggccagcaccaaggctatggctttgtggaattcttgagtgaggaagatgctgactatgccattaagatcatgaacatgatcaaactctatgggaagccaatacgggtgaacaaagcatcagctcacaacaaaaacctggatgtaggggccaacattttcattgggaacctggaccctgagattgatgagaagttgctttatgatactttcagcgcctttggggtcatcttacaaacccccaaaattatgcgggaccctgacacaggcaactccaaaggttatgcctttattaattttgcttcatttgatgcttcggatgcagcaattgaagccatgaatgggcagtacctctgtaaccgtcctatcaccgtatcttatgccttcaagaaggactccaagggtgagcgccatggctcagcagccgaacgacttctggcagctcagaacccgctctcccaggctgatcgccctcatcagctgtttgcagatgcacctcctccaccctctgctcccaatcctgtggtatcatcattggggtctgggcttcctccaccaggcatgcctcctcctggctccttcccacccccagtgccacctcctggagccctcccacctgggatacccccagccatgcccccaccacctatgcctcctggggctgcaggacatggccccccatcggcaggaaccccaggggcaggacatcctggtcatggacactcacatcctcacccattcccaccgggtgggatgccccatccagggatgtctcagatgcagcttgcacaccatggccctcatggcttaggacatccccacgctggacccccaggctctgggggccagccaccgccccgaccaccacctggaatgcctcatcctggacctcctccaatgggcatgcccccccgagggcctccattcggatctcccatgggtcacccaggtcctatgcctccgcatggtatgcgtggacctcctccactgatgcccccccatggatacactggccctccacgacccccaccctatggctaccagcgggggcctctccctccacccagacccactccccggccaccagttccccctcgaggcccacttcgaggccctctccctcagtaaattcacattttccttcctcctgttacattttcccaatatcttttctattccttggaccaatcagagatgctgtagctccttggggcaaaggtactaatccctttcagcacccccactccattcccctttttaatgtaactttttccacaggaggtatttcttttttatgttggtcctgagtattttgcaaatgcacagagaaaataaaactaaactccttgttta

SEQ ID NO: 29889 - DNA, 826 bp, Homo sapiens
ttgggggcggggtggccgggtgctggctgaggcctctgggtgtgatacttaagtccggtcccctgctgacttctcactcaaaaaatcaaaaaaacccactcacaatactaaattagacttcagaggattcccgaagtcctgggaagagagaagtttaaggatgccactgtgtacgtggggggcctggatgagaaggttagtgaaccgctgctgtgggaactgtttctccaggctggaccagtagtcaacacccacatgccaaaggatagagtcactggccagcaccaaggctatggctttgtggaattcttgagtgaggaagatgctgactatgccattaagatcatgaacatgatcaaactctatgggaagccaatacgggtgaacaaagcatcagctcacaacaaaaacctggatgtaggggccaacattttcattgggaacctggaccctgagattgatgagaagttgctttatgatactttcagcgcctttggggtcatcttacaaacccccaaaattatgcgggaccctgacacaggcaactccaaaggttatgcctttattaattttgcttcatttgatgcttcggatgcagcaattgaagccatgaatgggcagtacctctgtaaccgtcctatcaccgtatcttatgccttcaagaaggactccaagggtgagcgccatggctcagcagccgaacgacttctggcagctcagaacccgctctcccaggctgatcgccctcatcagctgtttgcagatgcacctcctccaccctctgctcccaatcctgtggtatcatcattggggtctgggcttcctc

SEQ ID NO: 29890 - DNA, 3747 bp, Homo sapiens
gccgcctgtgtcatccgccattttgtgagaagcaaggtggcctccacgtttcctgagcgtcttcttcgcttttgcctcgaccgccccttgaccacagacatgtctcgggatcggttccggagtcgtggcggtggcggtggtggcttccacaggcgtggaggaggcggcggccgcggcggcctccacgacttccgttctccgccgcccggcatgggcctcaatcagaatcgcggccccatgggtcctggcccgggccagagcggccctaagcctccgatcccgccaccgcctccacaccaacagcagcaacagccaccaccgcagcagccaccgccgcagcagccgccaccgcatcagccgccgccgcatccacagccgcatcagcagcagcagccgccgccaccgccgcaggactcttccaagcccgtcgttgctcagggacccggccccgctcccggagtaggcagcgcaccaccagcctccagctcggccccgcccgccactccaccaacctcgggggccccgccagggtccgggccaggcccgactccgaccccgccgcctgcagtcacctcggcccctcccggggcgccgccacccaccccgccaagcagcggggtccctaccacacctcctcaggccggaggcccgccgcctccgcccgcggcagtcccgggcccgggtccagggcctaagcagggcccaggtccgggtggtcccaaaggcggcaaaatgcctggcgggccgaagccaggtggcggcccgggcctaagtacgcctggcggccaccccaagccgccgcatcgaggcggcggggagccccgcgggggccgccagcaccacccgccctaccaccagcagcatcaccaggggcccccgcccggcgggcccggcggccgcagcgaggagaagatctcggactcggaggggtttaaagccaatttgtctctcttgaggaggcctggagagaaaacttacacacagcgatgtcggttgtttgttgggaatctacctgctgatatcacggaggatgaattcaaaagactatttgctaaatatggagaaccaggagaagtttttatcaacaaaggcaaaggattcggatttattaagcttgaatctagagctttggctgaaattgccaaagccgaactggatgatacacccatgagaggtagacagcttcgagttcgctttgccacacatgctgctgccctttctgttcgtaatctttcaccttatgtttccaatgaactgttggaagaagcctttagccaatttggtcctattgaaagggctgttgtaatagtggatgatcgtggaagatctacagggaaaggcattgttgaatttgcttctaagccagcagcaagaaaggcatttgaacgatgcagtgaaggtgttttcttactgacgacaactcctcgtccagtcattgtggaaccacttgaacaactagatgatgaagatggtcttcctgaaaaacttgcccagaagaatccaatgtatcaaaaggagagagaaacccctcctcgttttgcccagcatggcacgtttgagtacgaatattctcagcgatggaagtctttggatgaaatggaaaaacagcaaagggaacaagttgaaaaaaacatgaaagatgcaaaagacaaattggaaagtgaaatggaagatgcctatcatgaacatcaggcaaatcttttgcgccaagatctgatgagacgacaggaagaattaagacgcatggaagaacttcacaatcaagaaatgcagaaacgtaaagaaatgcaattgaggcaagaggaggaacgacgtagaagagaggaagagatgatgattcgtcaacgtgagatggaagaacaaatgaggcgccaaagagaggaaagttacagccgaatgggctacatggatccacgggaaagagacatgcgaatgggtggcggaggagcaatgaacatgggagatccctatggttcaggaggccagaaatttccacctctaggaggtggtggtggcataggttatgaagctaatcctggcgttccaccagcaaccatgagtggttccatgatgggaagtgacatgcgtactgagcgctttgggcagggaggtgcggggcctgtgggtggacagggtcctagaggaatggggcctggaactccagcaggatatggtagagggagagaagagtacgaaggcccaaacaaaaaaccccgattttagatgtgatatttaggctttcattccagtttgttttgtttttttgtttagataccaatcttttaaattcttgcattttagtaagaaagctatctttttatggatgttagcagtttattgacctaatatttgtaaatggtctgtttgggcaggtaaaattatgtaatgcagtgtttggaacaggagaatttttttttcctttttatttctttattttttcttttttactgtataatgtccctcaagtttatggcagtgtaccttgtgccactgaatttccaaagtgtaccaatttttttttttttactgtgcttcaaataaatagaaaaatagttataatattgatcttcaactttgccattcatgcttctatgcatattaggctacgtattccacattgaaagcatgagagtgtctaggcctttgaatggcatatgccatttctgggaaatgcatctggaggctaagtattgctttctacaaataattgccccctttgttttaaaaagaagaaatgcatattgaagtagtttgatgatttgtttggcatataggaagcacgctggtgctaagtattttttaaatggttatgtaagcaaagctgaactgtaaatcttcaggaatatgtattaagattgtggaatgggtgtaagacaattggtagggggtgaaagtgggtttgattaaatggatcttttatggccctatgatctatcctttacttgaaagcttttgaaaagtggaaaggtcattttgttgcatttccccatttcttgtttttaaaagaccaacaaatctcaagccctataaatggcttgtattgaacttttacatttgaattaaagatgttaaacatgaagtcttttcatgtattcaagtgatttataaagatggggtgtagtctaaaaaacaaaacttgaaagtaagaaggtttagtaactgggccgggcgcggtggctcacgcctgtaatcccagcactttgggaggctgaggtgggcaaatcatgagatcaggagttcaagaccagcctggccaacatggtgaaaccccgtctctactaaaaatacaaaaaattagctgggcgtggtggcaggcgcctgtaatcccagctactcgggaggctgagccaggagaattgcttgaacctggagatggaggttgcagtgagctgagactgccactgcactccagcctggacaacagagcgagactctgtctcaaaaaaaaaaaaaggtttagtactgaagtaggtttagttatatatacatttgtactctgtaacttttacatctccttgtgctacttctgttgggcaaaatctataggactataaaaatctattggttctcttctaagagctagtggtgattgttaacaaatagggttgcagataatcattcttattgtaaatttaacttgttttcacatagtttcgttttcatgtagcactaaatctggagaaagttgctcatgctacacagtacaaatatcccttcctcccaccataaaggcttggaatgtttcca

SEQ ID NO: 29891 - DNA, 6781 bp, Homo sapiens
gggagcaggggagttgtgaaatgggcggctagatctgcccggcgctgtgaattcgccagcgggagcgcgctcgcggccgcgcgttctccgctttcccggctccgtcgctgacgcgtcgtagacgttggggagcgggaaggcaacggcagcgggatcgggatgaacagcggcggcggcttcggtttgggcttaggcttcggcctcacccccacgtcggtgattcaggtgacgaatctgtcgtcggcggtgaccagcgagcagatgcggacgcttttttccttcctaggagaaatcgaggagctgcggctctaccccccggacaacgcacctcttgctttttcctccaaagtatgttatgttaagtttcgtgatccatcaagtgttggcgtggcccagcatctaactaacacggtttttattgacagagctctgatagttgttccttgtgcagaaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaaaataaatcactccaacaatgcaatagtaaaaccccctgagatgacacctcaggctgcagctaaggagttagaagaagtaatgaagcgagtacgagaagctcagtcatttatctcagcagctattgaaccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtgcttgaaattggtgcaaatatatacacacccttgtaagtgcaaagtatgtaagaagttttaacatttacttcacaggacttgtgattgtgttaaattctcactattgtgttttcttttgctcactgtttaggacaatttttctttaaaatagttttgcagattaaaattgcttaaataagtggattaaaaaactgacaatgcatgctactgttctctttcaaaaggaagagcaaccgtgttgaatactaataatgatgaattagtattcagtgtttagaatcattgggactacccacaaagtgagcatttctttttaaattttcttgacatttccaagcttattatgaataatattgcagtgtgtcttgtcagctgtaggtggcaaaggtgcccttataaaaaaggaaactggcttttcaaaatgggctatgggagcacaagctgaagctttagtgccttctacaatgtggtatactgttttctagaattttatatgtgctagtcattctcaattcatatggaatctagatggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagaaaaccctttagttgtctacattggatggccttattacctctcaatcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagaggaaaatgtttgtttatgcatttcaaaaaagcattttagttttatcctgctcattttagttgtcatagagattgttgtgacgtggagagtgcatgtttgtgtggtgtctataaaacaagtcatttaaagtatgagtgttttcttgtactctggacctattacatgtttctttatgttggtaattaacatttaatttggttcttgctgctaattattttctctgctgatatttattaagctttaaaataatcgtactataatcttgaaacactgatttgtaaaaactaagaatgagtaggaatacaagagatctggaggaacaaatcagattgttattagggtttgactttttttttacatgggcttatggaagcaaggcattctagggtctagagggatgtgtgtgtgtgcttgtgtgtccatgtgtgcgcatgcgcacgtgtgtatctgtttgagacatactttctctgttcacttaaaagagctcatgttttcatttgtttattcttttctttcagggtattttgtttttttctttaagacttctttttttaaatcccaggtagatgttgtcagataaacttgaggtaaggccaagaagacagacattttatgcttcatactttctgtaattatcttttgtagcttgattacatagagtaccctctcttccttaagttgtagttgctatttatcattgtagacaaattctgttgcctttcagcaacgtatgctgaactagtatcataagatggtgcatcagttcataagctagtgcataagttttgtgtcaaaacttttaaatcctgaagttctgcagttatcatcttagttattttctatctaattagcttataattgcaaacactagtcagcttgtgatctctgtgtttcaagttcttttcttcacgaggttcagtacctgctatgttgatctttggcagtgccagaggcttaaattttgacctgctcaattaaaaataaacactggcgtttataatgaaaaggtttttttgtcgggggggggggggtcaagagaatttattttgtgatagtaataattttcaagaccttcagtcattcctatgtctatgttgctatctttattttaaaacttagaaccctgatctaactcccttctcaagtgaagatactgtgtagattcaagaattataatgtagagtaataggcctttaagtttttttttaatctgttagaaataaagagcatgatttaattattgttgaattaacaattaaaatgaatccctttggagggatggcattgaataacttataatttcagtgaatcatttacgttttcattggaagacagtatctgatttcaactggtgcgttacgaagtagagccattcccacaaagtaaatgtgcagtgcccatgtttcttgtgtttaaatattttttattttcactacatatatattattttctcatgtttatttactaatgtaattttcacttaaaattagatgtttattttcaaattttaaaagctagtgctcttaaaagagctaaattatatttctggaagcaggagtttagtataaatgtaataaaattttaaaataaaattgacttccctacttaatcttgggtttgtgggtgagtttgtttttagtacactcttattggtggttttgcctgaagagtaatacattattattattacttttctttttgagacagggtctcactctgtcactcaggctggagtgcagtgacacgatcatggctcactgcaatcttgacctttctcggcatggatgatcctctcacctcagcctcttgaatagctgggaccacagacatgtgccaccaagcccagttaattttagaattttttttgtagagacaggatcttgccatgttgcctagactggtctcaaactcctgggctcaaacaatctgtctgcctcagccttctaaagtgctgagattacaggtgtgaggtactgcacctggcaatacgttattttaaaagtaaacgctaagccatttatgactttggttatattcagtcagttggatttagtaactaataactagctttcttccattctaaggtacttttatagtttctagcaattagtttgttacaattagcttatatcagatataacagttcttaatataatgtttataaaaggttttaagtctgttgcctgatttttaaatttatatctagttaacattttaattttaaaattgccaacttttgggagatttcacatattttacctctatattttatttttccaggattggtatggaggagtagtaccttctattcttggtttatttttatttgctagacataatttcttaactacatatgtaagtataaattcataaaaatcacactgaaagaataggttgatttcaaccattttgagggtactggtaggtaacacactgttggggaataaactaaagaatttctgatttctacaatagatttaagtatgaaatttgagtatactgtgtagctgtgtagatcaacttaatgcttaaaaaattacctccttaatgattagattaatagaacagtgttagattatcaagggaagagtttggaatgtaaacataaacatgctgcataggtggtggttatttgtgagtaggactacttttaaatggtactagtaaagatttatcaaacaatgctgctattatgttgctatatttttaataaaatgaaaatcttaaaatctt

SEQ ID NO: 29892 - DNA, 2433 bp, Homo sapiens
ttatttccccccgaacttaagatggccgcaggtgggcccggaacagccctcatggcaaacgtctcagagcgtttttccactctgaaaatcgcggagaccgcgcctgagccacagtccagtttttaaggccttggtgtcaggccgttttgctgacgagaaagcctgctgctggtgacaagatggaactggggctgtgtttgtttcccaggacggtcgcacaaacttagcattttggtttatctaaccgagcgcatccatgttcccaaagatcatgtctgttagcccttttgacagcagattaaattttcctcctgaaaggtcacactgtcccaaagctttcagaaaaagtcaacgcacctcttgctttttcctccaaagtatgttatgttaagtttcgtgatccatcaagtgttggcgtggcccagcatctaactaacacggtttttattgacagagctctgatagttgttccttgtgcagaagtgatgcagccaacacgaacggttgtcatgtgtaacacaactttcgatcaccgcgaaaacaccgtcctgggaaagcgtccatgcttgatatcgtttggttcatgaacattaagtttccagtacaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaaaataaatcactccaacaatgcaatagtaaaaccccctgagatgacacctcaggctgcagctaaggagttagaagaagtaatgaagcgagtacgagaagctcagtcatttatctcagcagctattgaaccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctga

SEQ ID NO: 29893 - DNA, 580 bp, Homo sapiens
agaactgctctctccaaagtcacctcctggttctcagtctacaacgcacctcttgctttttcctccaaagtatgttatgttaagtttcgtgatccatcaagtgttggcgtggcccagcatctaactaacacggtttttattgacagagctctgatagttgttccttgtgcagaagtgatgcagccaacacgaacggttgtcatgtgtaacacaactttcgatcaccgcgaaaacaccgtcctgggaaagcgtccatgcttgatatcgtttggttcatgaacattaagtttccagtacaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccag

SEQ ID NO: 29894 - DNA, 2222 bp, Homo sapiens
gtagacgttggggagcgggaaggcaacggcagcgggatcgggatgaacagcggcggcggcttcggtttgggcttaggcttcggcctcacccccacgtcggtgattcaggtgacgaatctgtcgtcggcggtgaccagcgagcagatgcggacgcttttttccttcctaggagaaatcgaggagctgcggctctaccccccggacaacgcacctcttgctttttcctccaaagtatgttatgttaagtttcgtgatccatcaagtgttggcgtggcccagcatctaactaacacggtttttattgacagagctctgatagttgttccttgtgcagaaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaaaataaatcactccaacaatgcaatagtaaaaccccctgagatgacacctcaggctgcagctaaggagttagaagaagtaatgaagcgagtacgagaagctcagtcatttatctcagcagctattgaaccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatc

SEQ ID NO: 29895 - DNA, 807 bp, Homo sapiens
attctttccccaagtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataatcttggtttggttcagaagtcttaatcttttgcttctaatcaattttcttgtcatgattttccaaaaccttattatatatagatagtaaaatttcatattatgaaattttcttttttttttttaatgttaactgagtgaggctcaggttaaatgatctggagtagatttcacctgattcccaattcagtacttttcttaaaccacatcaattaattgttacttctattttataaggaatttcttttacatcacattgaaccttaatctcttctgtattttgatagcttaggcaacatttgctgacattt

SEQ ID NO: 29896 - DNA, 1666 bp, Homo sapiens
caagggcgcagcctaggacaggggcttctggagcttctggcagccgtctgccctcatggcctttgcacctatggggcccgaggcctcgttcttcgacgttttggaccgacacagggagtccctgctggctgccctgaggagaggtggcagggagcccccaactgggggaagccgcctggcctccaggtttgaagattctgtgggtcttcagatggtatcccattgcaccaccagaaagatcaaaagtgattcaccaaaatcagctcaaaaattttctctaatccttaaaatattgtccatgatttataaattagtacagagcaacacttatgcaaccaaaagggacatatattacactgacagtcaactctttggtaaccagactgtcgtcgacaatattatcaatgacatttcttgcatgttaaaagtgtcaaggaggagtctacatatattatctacatcaaaaggtttaattgctggcaacttaagatacatcgaggaagatggcaccaaagtgaattgtacctgtggtgcaacggctgttgctgtgccatcgaatattcaaggaattcggaatttagttacagatgcaaagtttgtattaattgtagaaaaagatgcaacatttcagcggctcctagatgacaacttttgcaacaaattgtctccttgcatcatgattacgggaaagggagttcctgatctaaacacaagacttttagtcaagaaactgtgggatacatttcatgttcctgttttcactcttgtagatgctgatccacatggcatagaaataatgtgcatctataagtatggatctatgtctatgtcttttgaagctcatcatctcacagttccagctattagatggcttggtcttctcccttctgatcttaaaagattaaatgtacctaaagatagtttgattccactgacaaaaagggaccaaatgaaacttgacagtatcctgaggagaccttatgttacctgccaaccattttggagaaaagaaatggaaataatggcagactctaaaatgaaggcagaaattcaagctttgactttcctatcatcagattatctttccagagtgtacttacctaacaaattaaaatttggaggatggatataaaaataaatcagaagaacttctgattgccagaggcttttcattagttttgttttgattggcaaatactattgtggaaagaacatatattatattcttaattctgtaaaagtgaaataaaataactttccgttaattatatatttttgtcaaaacaaatgctgtactccaattttctttgcaaggccttattcttgcctctatagagacagatttctgtcctatcttctaaagcaaattataaaagaatatgttattttgacctttaaattatttttgaaaaaataatattttatacatgtcatcaaagtctacaaaatatttaccttctacgatacaactaatgttaacgcataaagtatcttactggtaacaaaaatcataatgatctgaatttgagatgttgcaaatgaattgtggtgtccggtagtttcttcttacattttcctttgcctttatactttaggggtcttactccattaattcatttgttacattagtaaaattcagtatgaataaatatttggattgatgtag

SEQ ID NO: 29897 - DNA, 1608 bp, Homo sapiens
tctgccctcatggcctttgcacctatggggcccgaggcctcgttcttcgacgttttggaccgacacagggagtccctgctggctgccctgaggagaggtggcagggagcccccaactgggggaagccgcctggcctccaggtttgaagattctgtgggtcttcagatggtatcccattgcaccaccagaaagatcaaaagtgattcaccaaaatcagctcaaaaattttctctaatccttaaaatattgtccatgatttataaattagtacagagcaacacttatgcaaccaaaagggacatatattacactgacagtcaactctttggtaaccagactgtcgtcgacaatattatcaatgacatttcttgcatgttaaaagtgtcaaggaggagtctacatatattatctacatcaaaaggtttaattgctggcaacttaagatacatcgaggaagatggcaccaaagtgaattgtacctgtggtgcaacggctgttgctgtgccatcgaatattcaaggaattcggaatgcaaagtttgtattaattgtagaaaaagatgcaacatttcagcggctcctagatgacaacttttgcaacaaattgtctccttgcatcatgattacgggaaagggagttcctgatctaaacacaagacttttagtcaagaaactgtgggatacatttcatgttcctgttttcactcttgtagatgctgatccacatggcatagaaataatgtgcatctataagtatggatctatgtctatgtcttttgaagctcatcatctcacagttccagctattagatggcttggtcttctcccttctgatcttaaaagattaaatgtacctaaagatagtttgattccactgacaaaaagggaccaaatgaaacttgacagtatcctgaggagaccttatgttacctgccaaccattttggagaaaagaaatggaaataatggcagactctaaaatgaaggcagaaattcaagctttgactttcctatcatcagattatctttccagagtgtacttacctaacaaattaaaatttggaggatggatataaaaataaatcagaagaacttctgattgccagaggcttttcattagttttgttttgattggcaaatactattgtggaaagaacatatattatattcttaattctgtaaaagtgaaataaaataactttccgttaattatatatttttgtcaaaacaaatgctgtactccaattttctttgcaaggccttattcttgcctctatagagacagatttctgtcctatcttctaaagcaaattataaaagaatatgttattttgacctttaaattatttttgaaaaaataatattttatacatgtcatcaaagtctacaaaatatttaccttctacgatacaactaatgttaacgcataaagtatcttactggtaacaaaaatcataatgatctgaatttgagatgttgcaaatgaattgtggtgtccggtagtttcttcttacattttcctttgcctttatactttaggggtcttactccattaattcatttgttacattagtaaaattcagtatgaataaatatttggattgatgtag

SEQ ID NO: 29898 - DNA, 1834 bp, Homo sapiens
ggcgtgggcacgccggccgctcagaaagcgcgggaaaggcacgcagccacgccccaagggcgcagcctaggacaggggcttctggagcttctggcagccgtctgccctcatggcctttgcacctatggggcccgaggcctcgttcttcgacgttttggaccgacacagggagtccctgctggctgccctgaggagaggtggcagggagcccccaactgggggaagccgcctggcctccagttctgaggttcttgcatctatagaaaatattatccaagacataatcacaagcttggcaagaaatgaagcacctgcattcacgatagacaacagatcaagctgggaaaacataaagtttgaagattctgtgggtcttcagatggtatcccattgcaccaccagaaagatcaaaagtgattcaccaaaatcagctcaaaaattttctctaatccttaaaatattgtccatgatttataaattagtacagagcaacacttatgcaaccaaaagggacatatattacactgacagtcaactctttggtaaccagactgtcgtcgacaatattatcaatgacatttcttgcatgttaaaagtgtcaaggaggagtctacatatattatctacatcaaaaggtttaattgctggcaacttaagatacatcgaggaagatggcaccaaagtgaattgtacctgtggtgcaacggctgttgctgtgccatcgaatattcaaggaattcggaatttagttacagatgcaaagtttgtattaattgtagaaaaagatgcaacatttcagcggctcctagatgacaacttttgcaacaaattgtctccttgcatcatgattacgggaaagggagttcctgatctaaacacaagacttttagtcaagaaactgtgggatacatttcatgttcctgttttcactcttgtagatgctgatccacatggcatagaaataatgtgcatctataagtatggatctatgtctatgtcttttgaagctcatcatctcacagttccagctattagatggcttggtcttctcccttctgatcttaaaagattaaatgtacctaaagatagtttgattccactgacaaaaagggaccaaatgaaacttgacagtatcctgaggagaccttatgttacctgccaaccattttggagaaaagaaatggaaataatggcagactctaaaatgaaggcagaaattcaagctttgactttcctatcatcagattatctttccagagtgtacttacctaacaaattaaaatttggaggatggatataaaaataaatcagaagaacttctgattgccagaggcttttcattagttttgttttgattggcaaatactattgtggaaagaacatatattatattcttaattctgtaaaagtgaaataaaataactttccgttaattatatatttttgtcaaaacaaatgctgtactccaattttctttgcaaggccttattcttgcctctatagagacagatttctgtcctatcttctaaagcaaattataaaagaatatgttattttgacctttaaattatttttgaaaaaataatattttatacatgtcatcaaagtctacaaaatatttaccttctacgatacaactaatgttaacgcataaagtatcttactggtaacaaaaatcataatgatctgaatttgagatgttgcaaatgaattgtggtgtccggtagtttcttcttacattttcctttgcctttatactttaggggtcttactccattaattcatttgttacattagtaaaattcagtatgaataaatatttggattgatgtag

SEQ ID NO: 29899 - DNA, 810 bp, Homo sapiens
ctgctggctgccctgaggagaggtggcagggagcccccaactgggggaagccgcctggcctccagttctgaggttcttgcatctatagaaaatattatccaagacataatcacaagcttggcaagaaatgaagcacctgcattcacgatagacaacagatcaagctgggaaaacataaagtttgaagattctgtgggtcttcagatggtatcccattgcaccaccagaaagatcaaaagtgattcaccaaaatcagctcaaaaattttctctaatccttaaaatattgtccatgatttataaattagtacagagcaacacttatgcaaccaaaagggacatatattacactgacagtcaactctttggtaaccagactgtcgtcgacaatattatcaatgacatttcttgcatgttaaaagtgtcaaggaggagtctacatatattatctacatcaaaaggtttaattgctggcaacttaagatacatcgaggaagatggcaccaaagtgaattgtacctgtggtgcaacggctgttgctgtgccatcgaatattcaaggaattcggattacagatgcaaagtttgtattaattgtagaaaaagatgcaacatttcagcggctcctagatgacaacttttgcaacaaattgtctccttgcatcatgattacgggaaagggagttcctgatctaaacacaagacttttagtcaagaaactgtgggatacatttcatgttcctgttttcactcttgtagatgctgatccacatggcatagaaataatgtgcatctataagtatggatctatg

SEQ ID NO: 29900 - DNA, 1869 bp, Homo sapiens
gacagggaggggaggggagggataggacagacagacaaagaaaggggtgcggcagcactgccaggggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccctggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgcggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactggtgcggctgcgacagagccccagggccttcatccctcccgccccagtcctgcccagcagggacaatgagattgtagacagcgcctcagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaa

SEQ ID NO: 29901 - DNA, 1783 bp, Homo sapiens
aggagcttccccagccacttccagcatgtagactgaagtcaggccacgcacagggctctccaggtcacaccctgcgcaagaaggtgtagcacgctggctctaatttcgagaaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccctggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgcggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactggtgcggctgcgacagagccccagggccttcatccctcccgccccagtcctgcccagcagggacaatgagattgtagacagcgcctcagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctc

SEQ ID NO: 29902 - DNA, 571 bp, Homo sapiens
gagccctgagccgccggctgcggggttggagccgccggctgcggggttggagccgccggctgcggggttggagacgccggctgcggggttggagccgccggctgcggggttggagccgccggctgcggggttggaaccgccggctgtgagtttcctcactgcttggaggaagatgagaattctcagaggtccttatgctgccctttttgctgcagtcttgacatcttaacgtggatagaaaaaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccctggccaaatacagcatcaccttcacgggcaagtggagccagacggccttccccaagcagtacccc

SEQ ID NO: 29903 - DNA, 597 bp, Homo sapiens
gatgcctgcgccgggagccaggagcttccccagccacttccagcatgtagactgaagtcaggccacgcacagggctctccaggtcacaccctgcgcaagaaggtgtagcacgctggctctaatttcgagaaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccctggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaagga

SEQ ID NO: 29904 - DNA, 549 bp, Homo sapiens
agagaaacccaagagcagctgcatgagccctcccaggcctacccccgcagccggcactccctgcagcaaagaaaaccatctggccactgggccctgagcccggcgcccggaggaggacctctgccccgctgagcagctctgctccccaggctggccctgggcctctcgcggcctgacccgctccccttggcatcaagcaccaggagggacggggtggcccggccagggcgtgggtgttccccggcccctctgagcaccagcacctgtttcctcactgcttggaggaagatgagaattctcagaggtccttatgctgccctttttgctgcagtcttgacatcttaacgtggatagaaaaaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctct

SEQ ID NO: 29905 - DNA, 557 bp, Homo sapiens
aagagccccgggaagagctgcatgcacacggctggagagaggctctgcacccgagcacagcctgctgcgactcctcatagacccggaaaactgattagaaggcagagggcctcctccctccctgcgtggtttgggggctgttcctgatagcacagatgccctgatcacaaacacctgcctgcattgctgaccacaggcctggcctggagaaacccacagcctcttcagggaagcgagcaaggggcttggaagtgcctgaagccagtgggctggggactcacggccgggacactcagggcagtttcctcactgcttggaggaagatgagaattctcagaggtccttatgctgccctttttgctgcagtcttgacatcttaacgtggatagaaaaaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgc

SEQ ID NO: 29906 - DNA, 556 bp, Homo sapiens
gtgtgtttgtgaactggcgatgtgatcgagggcacgggtgctgggcttccccctcatgggtaaaaccagagctactgtatgccagccgtggaggcatggacggcccctgagctcggacagcagacggacagaccgttgacgcgttggcaccgtggccagagtccgttcaagaaaggtcggcagagagggctgagaacgcggcaggcacatcctccaagggccctgctggaacccctggagcaggaggaagcggtgattctccaggccttggtttcctcactgcttggaggaagatgagaattctcagaggtccttatgctgccctttttgctgcagtcttgacatcttaacgtggatagaaaaaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgc

SEQ ID NO: 29907 - DNA, 307 bp, Homo sapiens
agcatgtagactgaagtcaggccacgcacagggctctccaggtcacaccctgcgcaagaaggtgtagcacgctggctctaatttcgagaaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgcc

SEQ ID NO: 29908 - DNA, 571 bp, Homo sapiens
ctgagccgccggctgcggggttggagccgccggctgcggggttggagccgccggctgcggggttggagacgccggctgcggggttggagccgccggctgcggggttggagccgccggctgcggggttggaaccgccggctgtgagtttcctcactgcttggaggaagatgagaattctcagaggtccttatgctgccctttttgctgcagtcttgacatcttaacgtggatagaaaaaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccctggccaaatacagcatcaccttcacgggcaagtggagccagacggccttccccaagcagtaccccctgttccgcc

SEQ ID NO: 29909 - DNA, 2348 bp, Homo sapiens
ggagtgagaccgctctgcaaaccactgcgtgctttgcagagtgattatcagcacagttccctgccctggataaggaacagctacagtcgctgttaaatgtgcctgaaaagcaatttgcaatctttgcattaggatttcagatgcatgccaggtttccactgattgccagaactcgagatcactacacatggatccccaaaatcaacatggcagtggcagttcgttagttgtgatccagcagccttctttggatagccgtcagagattagactatgagagagagattcagcctactgctattttgtccttagaccagatcaaggccataagaggcagcaatgaatacacagaagggccttcggtggtgaaaagacctgctcctcggacagcaccaagacaagaaaagcatgaaaggactcatgaaatcataccaattaatgtgaataataactacgagcacagacacacaagccacctgggacatgcagtactcccaagtaatgccaggggccccattttgagcagatcaaccagcactggaagtgcagccagctctgggagcaacagcagtgcctcttctgaacagggactgttaggaaggtcaccaccaaccagaccagtccctggtcataggtctgaaagggcaatccggacccagcccaagcaactgattgtggatgacttgaagggttccttgaaagaggacctgacacagcacaagttcatttgtgaacagtgtgggaagtgcaagtgtggagaatgcactgctcccaggaccctaccatcctgtttggcctgtaaccggcagtgcctttgctctgctgagagcatggtggaatatggaacctgcatgtgcttagtcaagggcatcttctaccactgctccaatgacgacgaaggggattcctattcagataatccttgctcctgttcacaatcacactgctgctctagatacctgtgtatgggagccatgtctttatttttaccttgcttactctgttatcctcctgctaaaggatgcctgaagctgtgcaggaggtgttatgactggatccatcgcccagggtgcagatgtaagaactccaacactgtctattgtaagctggagagctgcccctcccggggtcagggtaaaccatcatgatttttggaggtgggttgtacctcctgaacttttagctttcaagttgtggctgttttttgtttttgtttttgtttttgttttctttagaatttttccctgtttcccaccttctcttcccctgttgccaaggtctaactcatggatttttctctttcctcatggatgatcttcagcaagagtggactgggaagctgcacctggctcccactttcaacaagagcctctgccatccacttgagggtattgagagccagtgggcttttgtgtagcctttttgttctgcaagcaactttctaaagttgtgtacatgaacatacacccacatccagactacagtgatttagagttgttttgattgggtaccgtgggagcagggaaattggttttttaaaaagcaactgtttaattgcttaaataagctatgtattaaatctgtctccagttagggctatcttcctagcataggccccttaagtagcatgggggatatattttttgctataacgtaaaaattttcctttaaccactgccctctccttctttctccttcaaggttctttccccctcagttttgttgttgtcttactctggagatgccaagtgtattttttctttctatgtaattttagattcgccttacaatgtaaatcttcacattggagataatattggttggaccttgcccatcttcactctagccttcgtatttgtgaaggactcagccaccttccttcttcaccccatgcttctcaccaaatttttgttgtcattgagggcacttggataactcaagttgatatttatagctgatcaatctatatgtgtcacagaactatgctgcctaaagtgatcttggctccttaatggtccttttggccccttggatagttaacagctgagtaattctaatctcttctgtgttttccttgccttaaccacaaattgtggtgctttttgtatattttatgtataaatcacaaagttgaattctgactatttttaagacaaaagtctgttaaacttttttattgtaaagaatatttattatgcgaatctctattattttatggtatttattgcaaaagactgttgaaatgtactcatgtttgaatataacaaaatatcaatacttaacggaaaataaggtgacacgaagaaagtacatatgttaactataatgcagaaaatatattaattaatg

SEQ ID NO: 29910 - DNA, 2504 bp, Homo sapiens
tatttattcagtgcggattgcagagggcgcagctccaccgtggtaacttgcaatgtggccgcccctgcgctggcttctttctcctcggccctcggtgaacccagcttttcctttaaagcatagacaaatccttgcttagggtcagccagaccgtgggcttgctttgggctcccgcgtggacgctgaaggctcttcatgatttctcagaaaccttggtgggccacccaaaaagtgtgttggaaatccacggtgatccttaatatggtgatgggattgtccgaaaaggatttcagatgcatgccaggtttccactgattgccagaactcgagatcactacacatggatccccaaaatcaacatggcagtggcagttcgttagttgtgatccagcagccttctttggatagccgtcagagattagactatgagagagagattcagcctactgctattttgtccttagaccagatcaaggccataagaggcagcaatgaatacacagaagggccttcggtggtgaaaagacctgctcctcggacagcaccaagacaagaaaagcatgaaaggactcatgaaatcataccaattaatgtgaataataactacgagcacagacacacaagccacctgggacatgcagtactcccaagtaatgccaggggccccattttgagcagatcaaccagcactggaagtgcagccagctctgggagcaacagcagtgcctcttctgaacagggactgttaggaaggtcaccaccaaccagaccagtccctggtcataggtctgaaagggcaatccggacccagcccaagcaactgattgtggatgacttgaagggttccttgaaagaggacctgacacagcacaagttcatttgtgaacagtgtgggaagtgcaagtgtggagaatgcactgctcccaggaccctaccatcctgtttggcctgtaaccggcagtgcctttgctctgctgagagcatggtggaatatggaacctgcatgtgcttagtcaagggcatcttctaccactgctccaatgacgacgaaggggattcctattcagataatccttgctcctgttcacaatcacactgctgctctagatacctgtgtatgggagccatgtctttatttttaccttgcttactctgttatcctcctgctaaaggatgcctgaagctgtgcaggaggtgttatgactggatccatcgcccagggtgcagatgtaagaactccaacactgtctattgtaagctggagagctgcccctcccggggtcagggtaaaccatcatgatttttggaggtgggttgtacctcctgaacttttagctttcaagttgtggctgttttttgtttttgtttttgtttttgttttctttagaatttttccctgtttcccaccttctcttcccctgttgccaaggtctaactcatggatttttctctttcctcatggatgatcttcagcaagagtggactgggaagctgcacctggctcccactttcaacaagagcctctgccatccacttgagggtattgagagccagtgggcttttgtgtagcctttttgttctgcaagcaactttctaaagttgtgtacatgaacatacacccacatccagactacagtgatttagagttgttttgattgggtaccgtgggagcagggaaattggttttttaaaaagcaactgtttaattgcttaaataagctatgtattaaatctgtctccagttagggctatcttcctagcataggccccttaagtagcatgggggatatattttttgctataacgtaaaaattttcctttaaccactgccctctccttctttctccttcaaggttctttccccctcagttttgttgttgtcttactctggagatgccaagtgtattttttctttctatgtaattttagattcgccttacaatgtaaatcttcacattggagataatattggttggaccttgcccatcttcactctagccttcgtatttgtgaaggactcagccaccttccttcttcaccccatgcttctcaccaaatttttgttgtcattgagggcacttggataactcaagttgatatttatagctgatcaatctatatgtgtcacagaactatgctgcctaaagtgatcttggctccttaatggtccttttggccccttggatagttaacagctgagtaattctaatctcttctgtgttttccttgccttaaccacaaattgtggtgctttttgtatattttatgtataaatcacaaagttgaattctgactatttttaagacaaaagtctgttaaacttttttattgtaaagaatatttattatgcgaatctctattattttatggtatttattgcaaaagactgttgaaatgtactcatgtttgaatataacaaaatatcaatacttaacggaaaataaggtgacacgaagaaagtacatatgttaactataatgcagaaaatatattaattaatgaaa

SEQ ID NO: 29911 - DNA, 641 bp, Homo sapiens
gtagccggagtgagaccgctctgcaaaccactgcgtgctttgcagagtgattatcagcacagttccctgccctggataaggaacagctacagtcgctgttaaatgtgcctgaaaagcaatttgcaatctttgcattaggcatttcggccgtggaaccccaggctcggaggactgggtgtgagcgctgcccgggagaggctgacctgccgggaccggagtgcccggggacgctgtgcccccacttgcccaacgtgcggaatcggctaagcgcgtcggcctgcgcggggcacaagggacgacgcccgcctttctctctccgagaaggatccccaaacctcactctcttcactcctccccgctaaaaaaaaaaaaaaaaagaaaagggatttcagatgcatgccaggtttccactgattgccagaactcgagatcactacacatggatccccaaaatcaacatggcagtggcagttcgttagttgtgatccagcagccttctttggatagccgtcagagattagactatgagagagagattcagcctactgctattttgtccttagaccagatcaaggccataagaggcagcaatgaatacacagaagggccttcggtggtgaaaagacctgctcctcggacag

SEQ ID NO: 29912 - DNA, 1012 bp, Homo sapiens
ttgtaaaaactggttcttggaaaggggctgcagaagacctcccgaggtggatgttactgagccgcccggcgagcaccagccgtgacaggtccgggcccggccgcgcggagccgcgggagaactgccctccgcagccggaagggggccgcggggagcgctcctggccggtggcggcgggggcgggggaggccgcgagccgaggcgctccaactccggcgatgccgcctcgccctccccgccgcggttgatgcggcacgtgcacgccgccgcccgcaccaggacctgggccgggtcgcacggcttggcccccggccaccgcttcggcctaggatttcagatgcatgccaggtttccactgattgccagaactcgagatcactacacatggatccccaaaatcaacatggcagtggcagttcgttagttgtgatccagcagccttctttggatagccgtcagagattagactatgagagagagattcagcctactgctattttgtccttagaccagatcaaggccataagaggcagcaatgaatacacagaagggccttcggtggtgaaaagacctgctcctcggacagcaccaagacaagaaaagcatgaaaggactcatgaaatcataccaattaatgtgaataataactacgagcacagacacacaagccacctgggacatgcagtactcccaagtaatgccaggggccccattttgagcagatcaaccagcactggaagtgcagccagctctgggagcaacagcagtgcctcttctgaacagggactgttaggaaggtcaccaccaaccagaccagtccctggtcataggtctgaaagggcaatccggacccagcccaagcaactgattgtggatgacttgaagggttccttgaaagaggacctgacacagcacaagttcatttgtgaacagtgtgggaagtgcaagtgtggagaatgcactgctcccaggaccctaccatcctgtttggcctgtaaccggcagtgccttt

SEQ ID NO: 29913 - DNA, 573 bp, Homo sapiens
agtatgaagtttgttacaactatcattggaaatgcaaattgaagttgtgcctggtgttatgggttacactattcaaatcctctgcggttttgtgaatctggcttagtacttttagctaccttttgctttgaaagcactgagttaagaagttcttgaagaagaggaataattgtgcaggagtcaggattagatgttgaggactccgagactaaatccccgcaggttatgaatgtgttactcctcatgcgcaaagaaggtagaataaagtagaaactcgagagagctgagttgtgaaaacgagggggagctccaagaagttaacatgtaagacatagtttagagacattagtttaggaaatataggaaatggacttctttctgcgttgttccttaaaccatgttttttgcctcaggatttcagatgcatgccaggtttccactgattgccagaactcgagatcactacacatggatccccaaaatcaacatggcagtggcagttcgttagttgtgatccagcagccttctttggatagccgtcagagattagactatgagagagagattcagcct

SEQ ID NO: 29914 - DNA, 2708 bp, Homo sapiens
ggggggactgggaaagagaagaggggcggaggtagggagtccagctttgaagaaggaggccagggatcggatcggcagaaatcacttaaaaaataaaaacaaaaaagcccccttttatttcaaagatgctactttgactgcaagcaaatctgcaccgaaagtttacagctccgggagctgggtcctgcgcgcccggagtgagcagtgggaccctggaaaatgccctttttttaaaaagccatttttctttcactttaagaaatatgatatcttttttttttctctcgacccaaaaggagataggcgtgtgcagattacaggcaatgcccccttcggtcagtgcagcgtggagtcgccgtgtgtgcgtgggttggacttgtgcgtcctggctgcgtgtctcaggcagggctttcgtgctcgcagtgtcggggtgggaaacctgtgccggatgtccgaggggctttgcagaaagcctggcagtgggcggcgtgacctctgcctgggggcggagtggctccttggggctggaaggcagttctcttgagttgggggagatcttagctggggagagggaggcgggggaagtgtgctcctgcatttcgtgacacgtacccttcggaggcgcccgcggcccccgcctgtctgagtctggggatcgtaagcaggggggcagcctggcccatggacagcgtcagtccgcctggagaaactcccctggggatcggctgtgtcccacctgctggggacggtgttggggcacagagaggcgataaactaagtgaaagcaaagagcagcgttgtcttctgccattcttttggaggtgaggagatccggtttccagcactgccttgctccgaattgggagacgtttgtcacctgccttgttcgctgtggcctctattctaaagagcggagatcggataaaggagttcagatgtgttctaagcctgctggagtgaccacacttccaagacctgatggaggccagagctcagagtggcaacgggtcgcagcccttgctgcagacgccccgtgacggtggcagacagcgtggggagcccgaccccagagacgccctcacccagcaggtacatgtcttgtctctggatcagatcagagccatccgaaacaccaatgagtacacagaggggcctactgtcgtcccaagacctgggctcaagcctgctcctcgcccctccactcagcacaaacacgagagactccacggtctgcctgagcaccgccagcctcctaggctccagcactcgcaggtccattcttctgcacgagcccctctgtccagatccataagcacggtcagctcagggtcgcggagcagtacgaggacaagtaccagcagcagctcctctgaacagagactgctaggatcatccttctcctccgggcctgttgctgatggcataatccgggtgcaacccaaatctgagctcaagccaggtgagcttaagccactgagcaaggaagatttgggcctgcacgcctacaggtgtgaggactgtggcaagtgcaaatgtaaggagtgcacctacccaaggcctctgccatcagactggatctgcgacaagcagtgcctttgctcggcccagaacgtgattgactatgggacttgtgtatgctgtgtgaaaggtctcttctatcactgttctaatgatgatgaggacaactgtgctgacaacccatgttcttgcagccagtctcactgttgtacacgatggtcagccatgggtgtcatgtccctctttttgccttgtttatggtgttaccttccagccaagggttgccttaaattgtgccaggggtgttatgaccgggttaacaggcctggttgccgctgtaaaaactcaaacacagtttgctgcaaagttcccactgtcccccctaggaactttgaaaaaccaacatagcatcattaatcaggaatattacagtaatgaggattttttctttctttttttaatacacatatgcaaccaactaaacagttataatcttggcactgttaatagaaaggtgggatagtctttgctgtttgcggtgaaatgctttttgtccatgtgccgttttaactgatatgcttgttagaactcagctaatggagctcaaagtatgagatacagaacttggtgacccatgtattgcataagctaaagcaacacagacactcctaggcaaagtttttgtttgtgaatagtacttgcaaaacttgtaaattagcagatgacttttttccattgttttctccagagagaatgtgctatatttttgtatatacaataatatttgcaactgtgaaaaacaagttgtgccatactacatggcacagacacaaaatattatactaatatgttgtacattcggaagaatgtgaatcaatcagtatgtttttagattgtattttgccttacagaaagcctttattgtaagactctgatttccctttggacttcatgtatattgtacagttacagtaaaattcaacctttattttctaattttttcaacatattgtttagtgtaaagaatatttatttgaagttttattattttataaaaaagaatatttattttaagaggcatcttacaaattttgccccttttatgaggatgtgatagttgctgcaaatgaggggttacagatgcatatgtccaatataaaatagaaaatatattaacgtttgaaattaaa

SEQ ID NO: 29915 - DNA, 2111 bp, Homo sapiens
gtaaggccgttttcttttcccattcgctcatctgccaggaaaagggacttgccgttggcgcttcggcctcttgttcattgagaaaaaagaggaaatactccgcgtgcgcttgtagaaggggagtcgtctccagctccgaaccccggagtgttcatcagcggggaatctggctccgaattctctttttttctcccgccgattgctcggaagttggtctaaagcagaggttggaaagaaaggaaaaaagtttgcatcgagactggatttatttgcacatcgcagaaagaagagaatccaagggagaggggttggtgcaaagccgcgatcacggagttcagatgtgttctaagcctgctggagtgaccacacttccaagacctgatggaggccagagctcagagtggcaacgggtcgcagcccttgctgcagacgccccgtgacggtggcagacagcgtggggagcccgaccccagagacgccctcacccagcaggtacatgtcttgtctctggatcagatcagagccatccgaaacaccaatgagtacacagaggggcctactgtcgtcccaagacctgggctcaagcctgctcctcgcccctccactcagcacaaacacgagagactccacggtctgcctgagcaccgccagcctcctaggctccagcactcgcaggtccattcttctgcacgagcccctctgtccagatccataagcacggtcagctcagggtcgcggagcagtacgaggacaagtaccagcagcagctcctctgaacagagactgctaggatcatccttctcctccgggcctgttgctgatggcataatccgggtgcaacccaaatctgagctcaagccaggtgagcttaagccactgagcaaggaagatttgggcctgcacgcctacaggtgtgaggactgtggcaagtgcaaatgtaaggagtgcacctacccaaggcctctgccatcagactggatctgcgacaagcagtgcctttgctcggcccagaacgtgattgactatgggacttgtgtatgctgtgtgaaaggtctcttctatcactgttctaatgatgatgaggacaactgtgctgacaacccatgttcttgcagccagtctcactgttgtacacgatggtcagccatgggtgtcatgtccctctttttgccttgtttatggtgttaccttccagccaagggttgccttaaattgtgccaggggtgttatgaccgggttaacaggcctggttgccgctgtaaaaactcaaacacagtttgctgcaaagttcccactgtcccccctaggaactttgaaaaaccaacatagcatcattaatcaggaatattacagtaatgaggattttttctttctttttttaatacacatatgcaaccaactaaacagttataatcttggcactgttaatagaaaggtgggatagtctttgctgtttgcggtgaaatgctttttgtccatgtgccgttttaactgatatgcttgttagaactcagctaatggagctcaaagtatgagatacagaacttggtgacccatgtattgcataagctaaagcaacacagacactcctaggcaaagtttttgtttgtgaatagtacttgcaaaacttgtaaattagcagatgacttttttccattgttttctccagagagaatgtgctatatttttgtatatacaataatatttgcaactgtgaaaaacaagttgtgccatactacatggcacagacacaaaatattatactaatatgttgtacattcggaagaatgtgaatcaatcagtatgtttttagattgtattttgccttacagaaagcctttattgtaagactctgatttccctttggacttcatgtatattgtacagttacagtaaaattcaacctttattttctaattttttcaacatattgtttagtgtaaagaatatttatttgaagttttattattttataaaaaagaatatttattttaagaggcatcttacaaattttgccccttttatgaggatgtgatagttgctgcaaatgaggggttacagatgcatatgtccaatataaaatagaaaatatattaacgtttgaaattaaa

SEQ ID NO: 29916 - DNA, 1250 bp, Homo sapiens
agggtgagaaaaaggcagggtgccgggtggagggagtgcccgcctctgctccgtgtggacagtctagcccggagcgggtgggagcgtcgccctgcctggcgccgggtctctgcggttcggaagtgcagctctctctcttccgttcttcgtggtcagcctgggtcacacttattttatttttggaagctcgggctgacccagcgcaggaagaaagtcatcaagcggtcgcgatcattttccattacctgaaagagttcagatgtgttctaagcctgctggagtgaccacacttccaagacctgatggaggccagagctcagagtggcaacgggtcgcagcccttgctgcagacgccccgtgacggtggcagacagcgtggggagcccgaccccagagacgccctcacccagcaggtacatgtcttgtctctggatcagatcagagccatccgaaacaccaatgagtacacagaggggcctactgtcgtcccaagacctgggctcaagcctgctcctcgcccctccactcagcacaaacacgagagactccacggtctgcctgagcaccgccagcctcctaggctccagcactcgcaggtccattcttctgcacgagcccctctgtccagatccataagcacggtcagctcagggtcgcggagcagtacgaggacaagtaccagcagcagctcctctgaacagagactgctaggatcatccttctcctccgggcctgttgctgatggcataatccgggtgcaacccaaatctgagctcaagccaggtgagcttaagccactgagcaaggaagatttgggcctgcacgcctacaggtgtgaggactgtggcaagtgcaaatgtaaggagtgcacctacccaaggcctctgccatcagactggatctgcgacaagcagtgcctttgctcggcccagaacgtgattgactatgggacttgtgtatgctgtgtgaaaggtctcttctatcactgttctaatgatgatgaggacaactgtgctgacaacccatgttcttgcagccagtctcactgttgtacacgatggtcagccatgggtgtcatgtccctctttttgccttgtttatggtgttaccttccagccaagggttgccttaaattgtgccaggggtgttatgaccgggttaacaggcctggttgccgctgtaaaaactcaaacacagtttgctgcaaagttcccactgtcccccctaggaactttgaaaaaccaacatag

SEQ ID NO: 29917 - DNA, 1689 bp, Homo sapiens
tgaggagatccggtttccagcactgccttgctccgaattgggagacgtttgtcacctgccttgttcgctgtggcctctattctaaagagcggagatcggataaaggagttcagatgtgttctaagcctgctggagtgaccacacttccaagacctgatggaggccagagctcagagtggcaacgggtcgcagcccttgctgcagacgccccgtgacggtggcagacagcgtggggagcccgaccccagagacgccctcacccagcaggtacatgtcttgtctctggatcagatcagagccatccgaaacaccaatgagtacacagaggggcctactgtcgtcccaagacctgggctcaagcctgctcctcgcccctccactcagcacaaacacgagagactccacggtctgcctgagcaccgccagcctcctaggctccagcactcgcaggtccattcttctgcacgagcccctctgtccagatccataagcacggtcagctcagggtcgcggagcagtacgaggacaagtaccagcagcagctcctctgaacagagactgctaggatcatccttctcctccgggcctgttgctgatggcataatccgggtgcaacccaaatctgagctcaagccaggtgagcttaagccactgagcaaggaagatttgggcctgcacgcctacaggtgtgaggactgtggcaagtgcaaatgtaaggagtgcacctacccaaggcctctgccatcagactggatctgcgacaagcagtgcctttgctcggcccagaacgtgattgactatgggacttgtgtatgctgtgtgaaaggtctcttctatcactgttctaatgatgatgaggacaactgtgctgacaacccatgttcttgcagccagtctcactgttgtacacgatggtcagccatgggtgtcatgtccctctttttgccttgtttatggtgttaccttccagccaagggttgccttaaattgtgccaggggtgttatgaccgggttaacaggcctggttgccgctgtaaaaactcaaacacagtttgctgcaaagttcccactgtcccccctaggactttgaaaaaccaacatagcatcattaatcaggaatattacagtaatgaggattttttctttctttttttaatacacatatgcaaccaactaaacagttataatcttggcactgttaatagaaaggtgggatagtctttgctgtttgcggtgaaatgctttttgtccatgtgccgttttaactgatatgcttgttagaactcagctaatggagctcaaagtatgagatacagaacttggtgacccatgtattgcataagctaaagcaacacagacactcctaggcaaagtttttgtttgtgaatagtacttgcaaaacttgtaaattagcagatgacttttttccattgttttctccagagagaatgtgctatatttttgtatatacaataatatttgcaactgtgaaaaacaagttgtgccatactacatggcacagacacaaaatattatactaatatgttgtacattcggaagaatgtgaatcaatcagtatgtttttagattgtattttgccttacagaaagcctttattgtaagactctgatttccctttggacttcatgtatattgtacagttacagtaaaattcaacctttattttct

SEQ ID NO: 29918 - DNA, 9019 bp, Homo sapiens
tttgggaaatacgtccatcaagatttagatctgcctgtaaaatctatacaaagtatatgccactacaggtttgactcgccccctcccccgtttttttgttttgttttgttttgttttgttttgttttgtgttttctctgctgtgtcaaagaacaagacagaactatctctgtttctggctccactgcctgccagtgaaggagttttcattcagactttccgaagagaggtggagaaacctaaagactgaggagaagagatcctttgagccagatggggcattagttcttctgcttttctcagcatggataaaccatttcctcaaggattttctcatgtgccctgaaatccatgtaactacaagggctcctctttatcaccataagtgccaccctgacttaaaaccactcagagctaaaaaatcaaggcaaaatggatgctgcggtgacagatgattttcaacaaattctgcctattgaacagctgcgctctactcatgctagcaatgactacgtggaacggcctccagccccctgtaaacaggccctctccagcccttcccttattgtgcaaacccacaagtctgattggtctctggctaccatgcctacttctctcccccgcagtctcagccagtgccatcaactgcagcccttgcctcagcatctgagccaatctagcattgccagctcaatgtcccatagcaccactgcctctgatcaaaggctcttggccagcattacaccctcaccttcaggccaatccatcatccgaacccaacctggagcaggggtccacccaaaggctgatggtgctctgaagggagaagctgagcaatctgcagggcaccctagtgagcacctcttcatctgtgaggaatgtgggcgctgcaagtgcgtcccctgcacagcagctcgccctctcccctcctgctggctgtgcaaccagcgctgcctttgctctgctgagagcctcctcgattatggcacttgtctctgctgtgtcaagggcctcttctaccactgctccactgatgatgaagacaactgtgctgatgagccctgctcttgtgggcctagttcttgctttgtccgctgggcagccatgagcctcatctccctcttcctaccctgcctgtgctgctacctgcctacccgtggatgcctccatctgtgccaacagggctatgatagcctccggcgaccaggctgccgctgcaagaggcacaccaacactgtgtgcagaaagatctcttctggtagtgcacccttccccaaggcccaggaaaagtctgtatgaccttccaacaaggtggatccagagcttttctccttcgagtccccaacagcaaagcataggcctcatctttggagagggggaggagtgataaactagccaaagttagggcctctcttttgttcctgcagtgtcaggggaatgaccaagtacatcctggtgcaggatgccttgttctttctcacagtatctatcccactcctcttcagtctttacaccctgccagctcagcctttatggttgtcatggcaaattcaggtgatatatgggtatgaggtttgaacactgaggactgacagggccagcaacgtggaggtttaggggctccccaatgtaatacctctcgatgcaggctctgatcgtcactctgttttctgctgtgcctttggaagctttcttctaagatggttttcacaggtacatgtggaacagcgttcaaccttccagggaatacgaccccttctccctgttactgcccttctcttctttattcctctctcctctttcattattctgttctgtattcctttccccttcattctcaccctgtctgcttttactttttctctttcttcctccctttctccttctcccctccttctttttcagactgatcctttctctgcctgtatttctatctcatttgatctatatttgtctctctctacctgtccctttttctctaacatgtccaaaagtgctgtttttccatagatgtttccttagatgccaaactttgctatgctatactatttactaatttttattaagggaaatggattactgtaatgaactgatcactagcaatagtgtgtatcccgatgtgtgtgtgtgctcacaaccactctcacctgttcgtgagcgcatgaggcgaagttatcttatatttccaggtttaactagttggagtttttctccctttctcaataatcaacttatagtgctgacagattccactagcatgctgagtaggatagtaaatcaggatgctcataactttgtatgtctgacccaagtgccaaaggcagacgtgctttatagctaaatgaacaaagcaaaggatacagaggtatgttctctcttagaagctaacttccctgagactgcatggctcaggcgttaataatggacataaaaagtcataaaacgttagagctggaaggaatcttaactattaatctagttcaatgcccttattttacagatgggaaaactgaggcctggaggtaggaagggacttgcccccaaggccgcacactgagttaacagcagaattgagactggaatataggccttctgactcctagttcagtattcttacccctgtaccacattgagtcatgggactttttcctagggctctattaacagtgacagaaagccattcccattcaattacttttcaggaaccatgcctagttagtgtggtggtctttctccagtgcatggtgggtagctaattaactatcaggtgttgaggctgcccccagtggacatcacctttggctctgtcaccttgtagaagctcaagtgtggaaaagaaaagcttaaagaagccctaaccaagctgtatcttcgccattgcatctactctttgctgcacacactgtgcttgctcctggctttgtctgcaatggcagctgcctgagaacctaaatttcagcaacagtgaaaaactgagatgaaagatgtataatgtagagaactgacttctctcttaaaaagtacagagagcctgtgctgtgaacccccttcaatgggaaaaagctgcagtggtgatggcaggctcctaaagactgctgctaaaagacacaagaattatacagtttccctctataagtgaatccaaaattcactgacgaattcagagattgagggcacttgcttgaaatcaaggtgctccaacttagtttaagacctccagactctaactttatagatcatctcttctagagtgtgcatggatgtgtgttgcagggtggagaagtggggagaagtgtatagtagtacacggggggaagaggggacctccatgtccctttgttggatacatattacagaaatatgtgccactcactttttgttggttctgaatcttcctgaagtgtactgacatttgggctgcacagagccccacaccttcacttacacctcctcttctagaattgctttgctctatttttgtatatataaatatgttatgatgattattaataatgttaatgatattgctgcaaatggtgccatatataaggttaggcttcttggaacatttataaacccaaaccaatacctgtaacctcttatgttgctttcagatccttcaattttaagtaactttttaatcttacaagtctgcttgattgtactttacacttatctaccctgaaaagctctgcccagttctctgggtcaagctggatggtgatgagtagcaacacacacttctctgcttctgcctgaaatgtgcttagagctcagttatctaaggattctctgacactagtgcattgttcctggagctaaattattctatggatgtttgcttattagtttcaggccccaaaataacacgagcccctccaccttgatagctccttgatatcccaatcttgcagtcctaactcaggcaaattgtgcactgccagaggggccctgggttctgccatatacccagaggagcctttctcagtgtgtttctaaatggccttacacttggtagaagaaattgaagggttactcaaatacagttgcaatctgcaatctgctgttgagtcagggctttcacttgtgtccaagttggcctgatatggactgcatctgctttacgtatagatgggtcctgttgggatatgcgcatggacgtgtgagtgagtgtgcgtatgtatcccttctgtgattatatatattcacacatctctatatattttaatgtattgcacatgtatatttaaaatatatacgaaagaactctaaatcctgcagggaggctctgttttcattatttttctactttgtgtcatgtcctgtataaacaggaatatttagagggtgtttcctgcttagcatttttttgcagttaaatcatctgttagcccctaactctactgccttccacatattggttccttgatacatttcatatgatatcagccaagagttttcctgtggttccagcccatcttccctaatcacaatagcaataataaatatagtgaatacttacatagtgcttactatatgctaagcactatttttagcatgttatttatattagctcattcattcctcacaattctacaacataggtatcattccaacctctattttacagatgagaaaactgaagcacagagaagttaagtgacttgccaaaaggtaacaattgtaaatggtagagctaagatttgaacccagggtgtctgactcccaggtccatgctccagagtcagatatagaaggctggagcacagtgtaaaccattctggagtaacaagcctcaaatggtgaataattctttccctaactctggtccacctgcaacctaggagttaaaataagtatcttgctatgttaagagtaaagcaatagttacaggcatcatatattagctgtcttgctcccaaaatggtgacattacaaacttttccactattccctttgaaaacatgcttgcagccagttaccatttcttagcttatgatgtagagctattaagggagtattttcacttgtgccaaagagggtaagcgtttattagccttatctttattggccagggaaaactaattcaatttttttttgaacaaagtataactgagactatttttggagcttaagatttgttagagctgttaacattcaaccttattgattatattgagagcgctcttctgattcaaatgtaagcaaaccactgatgaccactggtccgtataacacattttaccaacagctccttcacactgaatcctttaacttggccaaaggacccttaaagaacatctagtccaatgtcaacattttatagctggagaaagggatgcacagagagggaaaataacctgtccaaagtcacacagttctgaaaattgagtggaattatgactttataccagagttcctaatttccaggtatcttagcctcagtttcttaaaaaatagagtttgaagcaaaagctatgtgcgatccagggtagtatgagtaaggaaagggttaatgagggagggaagaaagaagaacaaataaaaagcatgtcactgagttggccacggtctgttccttggcaagctaatttcgcaattttttgtgacagaccatataaaactactacatctccatacagcccacgtggtggaggaaaggaggtgaattcatctgctagctctcatctcattagtcaaattcttccccatgtgatatttacccttctacatttttgggtagtgcgtgatgggcacttaaatatgtaccttggcatttcatgcttcagcaataatgggaaggattgtggctccactataaacagtaaggcaagtatatgaatatagggagattaaatttaaagtgctacactagggtggtgcttttaccttatgtctttaatcacattccttcgaagtaagttagagataacctaccacctttaaagtaaataaagctttattgtggctcttagaactgtactatgtttgccttcctgagcctatttattctctagcttgctttaaagggcttcttttttatatggaaattaattccctgttcaattaaaggagtaacaaactctcaaaatatctttcttcttaatataaaaaggaatttcacattattgaactcctcaaaaagcatgtgtaagtcaaaatatgtatgtgaaggcacatatgttcttttaggttccatgagcataatagcaggaaaactggttaagtcaataaatgctggggaaaaaatggctaaacaaggtattctgtaacatgaaaataaagcaatgagttggttggctggctttttaaaaaatatttcagccactaattatgacacagacacattataagaattatgctaccttttattcacatatacaatagttccctgtgtcctatagatcattgtcacataaagcaaaagcattagtgccccatttggacctttggccgaaggtttgataagattttgtaggactgaaattcttggtccctttatcctagtttaggcccatatccttattttcactctcaaagataagatcatgacactaccagtgttgctgctgttaaaggccaggatggacaagataaggaaaggcattttgggaatgacactgactaatgttaggaatcttgctgtcattacaatccaagttatatatgtttgctcccatatgtatttgttggccaatctcctgaaaaagaagaaggtaattctaacccacacattgtcattcccaaactaacctggcaatccttttgaccataccaggtaatagtcatccctctgatggtaaaagacagagatgtcaaggctctggaagctcccaggtccttgaagaactaactaaactgctgaacacagaagtggtaatgtaggcaagccacaggtatgttctcttgtaacaagatggggttgaccatatgtgaaccctgaagagtcattttgaacctgtgtcctaaggcctagagtactttaatcctcatcttcaaagtcttaccactctgataacaaaaagaaacactacaaagaaactgcaaggaaagggacagtcattttttttaatatctaccaattatttagttattcatatatgcatttctttatatagaaaagtatttatatgaagtttccaaaagactctgatattcagctttatagtcttggatagaaaatcatgtgtccttggatggggattcgcacaccaaggcttaacagaattagtttggggaatactcatttttactctagagattagttggcttaaacaactttactcgtgaatttttttcttaatggaggtgaagacctcccaaagaggagaaggccccaggcctttcttaatatataaaccatattgaaagaaagaaagaaaaaagtaatgggaagtaatagtaaatgtggatccagaaagaaaaacaaaggttaagaaaatgatgtatgtgaaagaaaaaaagctctataatcagtgtgtttctctcacctaaaacaccatttactaactacttggttcagttgtaccctttaactctattttgtccttgacttatatcaacactcttcttttccaaactcctatagctctccatctggaatgattctatggggtggggggtcgggggaggagaaagggagacagcagaagaaagaaagagagagaaagatagagagagagagagagatgggtggagacttggcctctctcctagaggttcaaagttagaatatgccactaacactatctgcctttcaaactcccttctaggacatgctccatagtacttagatcttatatcaaatgacaaggtttctctccttcagagagaaataccagactggatttgtggtttccctggattggttttttctgagtcaaagtggtgttgtagaaatcacagtaccctgagaccaattaagtcagaatctttggaggtgttgaggaatggatttttaaagttcccagatgattataatatgcaaacagatttgagaaaattgaatcactttattccataaatgcagatagtgaggctaagagagggaaagtgacttactcataaccacaccgtgagttagtgaccaagtcaggataagaatccaggtctgctgactcctaggccagaattcttgtctttatactacactgcttctatctctaccctattccccctctgagcctttgcttttctcatctgtaaaatgacgataataaagcctagagagtgtatgagaatcattaaagcagaagcatttttcttaatgtacaaggttctatacaaatgcaagggaattaatgtataacatatatgtggggctaagtctctaaaacaacataataaaagttgtttttattttagtcaatcttttaggtattgtgtctacctgatagcatgtaacaagattgaacacttgtgtaggtcgtatgtgcctttaatctgaggttggcctcagtgacaatcaaaattagcagttgaggaaaaaggtcatacatttttctcttgcccttgctggaatagggatcaagaggaatataaaagcagtgggatatctggatttcttatactcagtcaaccacaacatggccttagtactgaactagcccagggtttcaatggaactcgtagatctcattcccaaggctggtcctggttgaagggagaaggtcaaaaaaggacgtgtcttctgaaaggcattacccatggaaagccaagggggagggttgcccactaggaggagcttcttttgtagaagccagaatggaggaaaggggctttctgacttggagcatctgaggaaatagattatttgaggatctagtactcccagaataatctgtaaccacaagaaacacatttcttgaactccagcgccccagaacaggatatccatatccaatcccatcgtatccatcctggatgttatgaatttccagagagggccacttctacccccctaggagtcatacatctggctacttatttgttaaaaataaaattctgtaccatttataaaa

SEQ ID NO: 29919 - DNA, 3302 bp, Homo sapiens
tttgggaaatacgtccatcaagatttagatctgcctgtaaaatctatacaaagtatatgccactacaggtttgactcgccccctcccccgtttttttgttttgttttgttttgttttgttttgttttgtgttttctctgctgtgtcaaagaacaagacagaactatctctgtttctggctccactgcctgccagtgaaggagttttcattcagactttccgaagagaggtggagaaacctaaagactgaggagaagagatcctttgagccagatggggcattagttcttctgcttttctcagcatggataaaccatttcctcaaggattttctcatgtgccctgaaatccatgtaactacaagggctcctctttatcaccataagtgccaccctgacttaaaaccactcagagctaaaaaatcaaggcaaaatggatgctgcggtgacagatgattttcaacaaattctgcctattgaacagctgcgctctactcatgctagcaatgactacgtggaacggcctccagccccctgtaaacaggccctctccagcccttcccttattgtgcaaacccacaagtctgattggtctctggctaccatgcctacttctctcccccgcagtctcagccagtgccatcaactgcagcccttgcctcagcatctgagccaatctagcattgccagctcaatgtcccatagcaccactgcctcttctaccactgctccactgatgatgaagacaactgtgctgatgagccctgctcttgtgggcctagttcttgctttgtccgctgggcagccatgagcctcatctccctcttcctaccctgcctgtgctgctacctgcctacccgtggatgcctccatctgtgccaacagggctatgatagcctccggcgaccaggctgccgctgcaagaggcacaccaacactgtgtgcagaaagatctcttctggtagtgcacccttccccaaggcccaggaaaagtctgtatgaccttccaacaaggtggatccagagcttttctccttcgagtccccaacagcaaagcataggcctcatctttggagagggggaggagtgataaactagccaaagttagggcctctcttttgttcctgcagtgtcaggggaatgaccaagtacatcctggtgcaggatgccttgttctttctcacagtatctatcccactcctcttcagtctttacaccctgccagctcagcctttatggttgtcatggcaaattcaggtgatatatgggtatgaggtttgaacactgaggactgacagggccagcaacgtggaggtttaggggctccccaatgtaatacctctcgatgcaggctctgatcgtcactctgttttctgctgtgcctttggaagctttcttctaagatggttttcacaggtacatgtggaacagcgttcaaccttccagggaatacgaccccttctccctgttactgcccttctcttctttattcctctctcctctttcattattctgttctgtattcctttccccttcattctcaccctgtctgcttttactttttctctttcttcctccctttctccttctcccctccttctttttcagactgatcctttctctgcctgtatttctatctcatttgatctatatttgtctctctctacctgtccctttttctctaacatgtccaaaagtgctgtttttccatagatgtttccttagatgccaaactttgctatgctatactatttactaatttttattaagggaaatggattactgtaatgaactgatcactagcaatagtgtgtatcccgatgtgtgtgtgtgctcacaaccactctcacctgttcgtgagcgcatgaggcgaagttatcttatatttccaggtttaactagttggagtttttctccctttctcaataatcaacttatagtgctgacagattccactagcatgctgagtaggatagtaaatcaggatgctcataactttgtatgtctgacccaagtgccaaaggcagacgtgctttatagctaaatgaacaaagcaaaggatacagaggtatgttctctcttagaagctaacttccctgagactgcatggctcaggcgttaataatggacataaaaagtcataaaacgttagagctggaaggaatcttaactattaatctagttcaatgcccttattttacagatgggaaaactgaggcctggaggtaggaagggacttgcccccaaggccgcacactgagttaacagcagaattgagactggaatataggccttctgactcctagttcagtattcttacccctgtaccacattgagtcatgggactttttcctagggctctattaacagtgacagaaagccattcccattcaattacttttcaggaaccatgcctagttagtgtggtggtctttctccagtgcatggtgggtagctaattaactatcaggtgttgaggctgcccccagtggacatcacctttggctctgtcaccttgtagaagctcaagtgtggaaaagaaaagcttaaagaagccctaaccaagctgtatcttcgccattgcatctactctttgctgcacacactgtgcttgctcctggctttgtctgcaatggcagctgcctgagaacctaaatttcagcaacagtgaaaaactgagatgaaagatgtataatgtagagaactgacttctctcttaaaaagtacagagagcctgtgctgtgaacccccttcaatgggaaaaagctgcagtggtgatggcaggctcctaaagactgctgctaaaagacacaagaattatacagtttccctctataagtgaatccaaaattcactgacgaattcagagattgagggcacttgcttgaaatcaaggtgctccaacttagtttaagacctccagactctaactttatagatcatctcttctagagtgtgcatggatgtgtgttgcagggtggagaagtggggagaagtgtatagtagtacacggggggaagaggggacctccatgtccctttgttggatacatattacagaaatatgtgccactcactttttgttggttctgaatcttcctgaagtgtactgacatttgggctgcacagagccccacaccttcacttacacctcctcttctagaattgctttgctctatttttgtatatataaatatgttatgatgattattaataatgttaatgatattgctgcaaatggtgccatatataaggttaggcttcttggaacatttataaacccaaaccaatacctgtaacctctt

SEQ ID NO: 29920 - DNA, 4938 bp, Homo sapiens
gcgagctgagctgacagcgcggagctggcgctgtggagcgcagggagccttgccggttcctccgaccggcgtctgcgagtacagcggcggctaacctgccccggcttcaggatttacacagacgtggggcgatgcttgtgaccctgcagctcctcaaaccagcctgtattgagcggtttgcagcctgatgctcagccccctccccacagggcccctagaagcctgtttctccgtacagtccaggacctccagccccatggagcccccgatcccacagagcgcccccttgactcccaactcagtcatggtccagccccttcttgacagccggatgtcccacagccggctccagcacccactcaccatcctacccattgaccaggtgaagaccagccatgtggagaatgactacatagacaaccctagcctggccctgaccaccggcccaaagcggacccggggcggggccccagagctggccccgacgcccgcccgctgtgaccaggatgtcacccaccattggatctccttcagcgggcgccccagctctgtgagcagcagcagcagcacatcctctgaccaacggctcttagaccacatggcaccaccacccgtggctgaccaggcctcaccaagggctgtgcgcatccagcccaaggtggtccactgccagccgctggacctcaagggcccggcggtcccacccgagctggacaagcacttcttgctgtgcgaggcctgtgggaagtgtaaatgcaaggagtgtgcatccccccggacgttgccttcctgctgggtctgcaaccaggagtgcctgtgctcagcccagactctggtcaactatggcacgtgcatgtgtttggtgcagggcatcttctaccactgcacgaatgaggacgatgagggctcctgcgctgaccacccctgctcctgctcccgctccaactgctgcgcccgctggtccttcatgggtgctctctccgtggtgctgccctgcctgctctgctacctgcctgccaccggctgcgtgaagctggcccagcgtggctacgaccgtctgcgccgccctggttgccgctgcaagcacacgaacagcgtcatctgcaaagcagccagcggggatgccaagaccagcaggcccgacaagcctttctgacagtttgtgtcgaagccccagtgctctgcctggaaacctggttctcttctgacatctaagaagactgcagcaaggtcagaggttttagcctcctgaggctgaccttgctagtctgcccactccctacccccagcttcggaaaatacagagaccaccaccacgtaccctgtattccccaaggtgatgaagaagcactttggggctttttttcagggtcctgaaactttgtgtcaaacagacaatgcaggggcagggtgtggtttggggggaaatttttctttttcagaagacagaacacagatgtggacacatatccggaaactgcagctgcttgaatgccttcccagcccctccttctccctccctccctccgcccccccccccttcctcttttccattgtctttggctctcacaggagctagctgcctgggaggaattgttaactgagtaccagggtacctttaaagaagacccttggagtcttctataccttcttctccttccccatctcactccaccccactttgtccctgatgtcttggggaaggtgtagaacaccctagcagttcctattgtatatacttgggagccactgagaacagaggacggccagtgagtccaagcctcgttcctccttctgcctccccggagccacaggatggatttaggagccactgctcagtgcacttctcccttccaactgcatcaactaactctcgggggtgttctgctcaccacaccgtccttcggttcttactgagtcacagactcgcctgcccactacgtgtcctgggttctctctactcagatcccttccagaaactttatatgggtagaggaagccagggcggcaaatgcgagaccaaatatcattttgccaatgagtctgaggctgtggtctctggatccagtcattatgtttttatagaataattaaaccggatgctaacggtgttttaaaaaataataataaaacaacttgtttccttttggccacccccaggaagggctgatttcaaaatctgggggcgagcaacctcaaggaacacaatttccctccctatcaacaagaggattttaacagcaaagaagagaggcagcacctcccattggcagaatgaccgctgagccaggctgggtttgggtttcttctcttctgattctgctgctcactgtcatagccttttgtgtatagtgatgtgtctgtatctttaatgtaaatagagagatgatgaaaaaagagtctattttagtgttaggaagccccagcaggggagtcggaagagcttggaagagctggggagagggtaggggaaaggtttttccaggggccactgggtttgagccctgcttctgtgcacagccacaccaccctctcccgacagccctcaaagacgtagcaactctttctctcaaggtgctaaaggactcagaaggtgcagcacgtccagtgggtaggtacttgttgcatgcaaaagctgtagtgtatctggtccttcctccccagcttttgtgtggggttcttgctttgtgtggtattttgttttcccctctaatgagagggcatggcctgagtcagaagagctaccccaggtgaaactggaagtgcatgaggcagagcgtccgtagcatttccagtttgttctgtataggaacagaggtgcctccgggaaggaggcagcgaggtaggtagctatgataggcacctaatgcttctcaaggacttattttttccttcttgaagactagtagtaacatcttatgatttagagtaagttgattgtaaccataggtatttattgattggaggaagggagggtcatattattttcggctttatttatgtaacatttgctagcttgtaaaaggcgaatgtgaaatattgcatctgcattttccaaggctgattcgtgtagctacccttgccacagttgtgacggatgtatggatgttcttgaacatttcagaaggagtggtagaaaaaaacacacattcagccaaccacttatatgaattgaatgtatcagaagtgtactgaagggactggagatggttttcctcagatgagggggccccaaaattgatagtgcacatctgcacgctttctgcgaggcctcagaacttcccagggcccctccctcaaattgtctccatgggaaacttgacccagtggcaagttgcactttggtgatcttggtggtctacacacccgttctgtggagagtcgatttacataagctgtgtatacacacacacacacacacacacacacccctaccccacactgactgtctaccgacaaagaccctatttcctggcaaacggcctcctgaaccctgactttttgtgtacatacttgtaaacacggatttttctgggttttggtttgctttttccttttttccccctgcccctgttctagcttgttcttcttggtttgctttcaacctgcttgatggatgtctgcagagtgctctctaagagtccacctcagtgcctcgtgtgctcagtggtcatgggaaaggagcgaaggaaccatccttggttctcccagcttggttgtgtagcaatccctcagcattgtttttctcagcttcttggcaaaaattaaaacaacaacaacaacaacaacaacaacaacaaacagaaggataaactggcttgcctgtggaccctccccggctctggggccagtcgagagccactgagggacccagcactcagagacacaacacacatgtgtagctgcttctggctgagtgtgtttcctgtcaccaatggcctgtttggctggacgatgcctcggcttgaccttttttgaaaagtgctggttagttcccgcccctggtaaacctggggtaggtgggggttctgtcttaactcgaggggcacctgggatccaggacgcttctagggggctctggctgcccgtgttaatgaaggacagcgcttccgcgagcaccctgggaactgggtcttgggtagcaaagccctcccagagaaaagattgggcacaactaaggctttcctgagcaggaagggggtgaagaccaatcccttcctttggtcctttggtacgcaccccctcagagctgagatggaagacatggctagttcttttcagccttgtggagcctgtcagtcgccatcatacctcgagtgaggcccagctagataatgacttgtccaagatggcacacgtggaaagttgatctgcaccagaacccggatgactgtcaccttgaagcatcctgttctccttctgtgctgtcccaggaagtgtctggcgggcgtgggcagcacagctctacactgtacgattcactagggcatcctgcgagcctcactagccttctggttcatgcctttgacaagcatttttgtgccccctctgcttactgtgacagtcgatgatgaatcttgcgttgccattttctgctgtgggtaactgcgtgcagtgtcttgccttgctttctcttcttactgtcccacagcttggtttcatgttacaaacagaaaagctcgaggctcccaccccgccacatcccaacttcatttccccctcactgtagcccatttccaccccaccacaaagttgccacaggttttctttgtatagaatatttattttgaagctctattttaatagtatttattttagaaagtctactattgtaagagttcttctgtttgtgaagaaaaaaacaagttaaaaactgaatgtactgatttagaaaatatatataaatatatattgttaaatatacacgggactgccgtt

SEQ ID NO: 29921 - DNA, 321 bp, Homo sapiens
atggagcccccgatcccacagagcgcccccttgactcccaactcagtcatggtccagccccttcttgacagccggatgtcccacagccggctccagcacccactcaccatcctacccattgaccaggtgaagaccagccatgtggagaatgactacatagacaaccctagcctggccctgaccaccggcccaaagcggacccggggcggggccccagagctggccccgacgcccgcccgctgtgaccaggatgtcacccaccattggatctccttcagcgggcgcccctgctctgctacctgcctgccaccggctgcgtga

SEQ ID NO: 29922 - DNA, 2379 bp, Homo sapiens
attttcccaggcagtggttgcaacatcgccgcggaggtagcgagctgagctgacagcgcggagctggcgctgtggagcgcagggagccttgccggttcctccgaccggcgtctgcgagtacagcggcggctaacctgccccggcttcaggatttacacagacgtggggcgatgcttgtgaccctgcagctcctcaaaggcccctagaagcctgtttctccgtacagtccaggacctccagccccatggagcccccgatcccacagagcgcccccttgactcccaactcagtcatggtccagccccttcttgacagccggatgtcccacagccggctccagcacccactcaccatcctacccattgaccaggtgaagaccagccatgtggagaatgactacatagacaaccctagcctggccctgaccaccggcccaaagcggacccggggcggggccccagagctggccccgacgcccgcccgctgtgaccaggatgtcacccaccattggatctccttcagcgggcgccccagctctgtgagcagcagcagcagcacatcctctgaccaacggctcttagaccacatggcaccaccacccgtggctgaccaggcctcaccaagggctgtgcgcatccagcccaaggtggtccactgccagccgctggacctcaagggcccggcggtcccacccgagctggacaagcacttcttgctgtgcgaggcctgtgggaagtgtaaatgcaaggagtgtgcatccccccggacgttgccttcctgctgggtctgcaaccaggagtgcctgtgctcagcccagactctggtcaactatggcacgtgcatgtgtttggtgcagggcatcttctaccactgcacgaatgaggacgatgagggctcctgcgctgaccacccctgctcctgctcccgctccaactgctgcgcccgctggtccttcatgggtgctctctccgtggtgctgccctgcctgctctgctacctgcctgccaccggctgcgtgaagctggcccagcgtggctacgaccgtctgcgccgccctggttgccgctgcaagcacacgaacagcgtcatctgcaaagcagccagcggggatgccaagaccagcaggcccgacaagcctttctgacagtttgtgtcgaagccccagtgctctgcctggaaacctggttctcttctgacatctaagaagactgcagcaaggtcagaggttttagcctcctgaggctgaccttgctagtctgcccactccctacccccagcttcggaaaatacagagaccaccaccacgtaccctgtattccccaaggtgatgaagaagcactttggggctttttttcagggtcctgaaactttgtgtcaaacagacaatgcaggggcagggtgtggtttggggggaaatttttctttttcagaagacagaacacagatgtggacacatatccggaaactgcagctgcttgaatgccttcccagcccctccttctccctccctccctccgcccccccccccttcctcttttccattgtctttggctctcacaggagctagctgcctgggaggaattgttaactgagtaccagggtacctttaaagaagacccttggagtcttctataccttcttctccttccccatctcactccaccccactttgtccctgatgtcttggggaaggtgtagaacaccctagcagttcctattgtatatacttgggagccactgagaacagaggacggccagtgagtccaagcctcgttcctccttctgcctccccggagccacaggatggatttaggagccactgctcagtgcacttctcccttccaactgcatcaactaactctcgggggtgttctgctcaccacaccgtccttcggttcttactgagtcacagactcgcctgcccactacgtgtcctgggttctctctactcagatcccttccagaaactttatatgggtagaggaagccagggcggcaaatgcgagaccaaatatcattttgccaatgagtctgaggctgtggtctctggatccagtcattatgtttttatagaataattaaaccggatgctaacggtgttttaaaaaataataataaaacaacttgtttccttttggccacccccaggaagggctgatttcaaaatctgggggcgagcaacctcaaggaacacaatttccctccctatcaacaagaggattttaacagcaaagaagagaggcagcacctcccattggcagaatgaccgctgagccaggctgggtttgggtttcttctcttctgattctgctgctcactgtcatagccttttgtgtatagtgatgtgtctgtatctttaatgtaaatagagagatgatg

SEQ ID NO: 29923 - DNA, 553 bp, Homo sapiens
ttttatgctatgcaactgccttgcagttgactttttcttgcctggcctctgtaaggcctgaggctcctcggccaccctgtacctccctatcctcgggcaccgagctgtgccaggccccggagcccccaggccgcgctagggctgcggtgggggttgaaggtgcgtttacataacaccaggcgtgtgggagctggaggaagaggttgcgaatgtaggagagataaggctcctgctttccctccttccttcttggtggtaccaggcttgacatcacagagaagaggatagagacgccagcctgtattgagcggtttgcagcctgatgctcagccccctccccacaggtacaaatgcaggcccctagaagcctgtttctccgtacagtccaggacctccagccccatggagcccccgatcccacagagcgcccccttgactcccaactcagtcatggtccagccccttcttgacagccggatgtcccacagccggctccagcacccactcaccatcctacccattgaccaggtgaagaccagccatgtggagaatg

SEQ ID NO: 29924 - DNA, 7780 bp, Homo sapiens
ctctcgggcgtgaggagctggcccgctgagctgctggtgggcactggctggcggggaacctgcagccgctcttgtcctctcccgccgcttctcgggatcctgccccccggacccgggcccgcccgctcttctccggccgggtgggaacgatcggtttgcctgcccctcgcctcacacgctccccgccgccccctccacccccctgaggaggagtcccggctggagcgtgtctggaggaatccgccgccgcggggcccctagccctgctctgccggcgcctgaggaccgacccagacgccgccgggggttgaggggcagccggcggcgaggcgggagatggtggggtgggctccggcaggaccgcgccgccgctgcccggagcctgggctcggcacccccccgccggcccccaccgagcggagctctgcttcctcctcgccgcatccctgagggaagcgccgcctctgctcccgggttctccgcccgccgactccttcctggccggaccccgctgcgctccaccccagtggctggaggagcagctctccagtcagcctttgcagcccctctctttttccctttccaccgggcctcctcggatcccttggctgggcactgaggcgggggaagaggctggggtcgccacggcggaggttgctgccgccacccccctgcgggggtggccggggttcccggctgggggggtaccgttctgggtgaggcatccaccatggtgaggcccctgtgccgctgcccccgcgcccccccggccgccgctgcctcctgcccctcggtgctgctgttgctcccccgcctgctgttgctcctccatctccagatcggatcacggtgagggaaagatgagcgaggagacggcgacttctgacaacgataatagttatgcacgagtgcgagctgtggtgatgacccgagatgactcaagtggtggatggttaccacttggagggagtggactaagcagcgtcactgtcttcaaagtccctcatcaggaagagaatggctgtgctgacttttttatccgtggagagcgactcagggacaaaatggtggttttggaatgtatgcttaaaaaagacctcatttataataaggtcactccaacatttcaccactggaagattgatgacaagaagtttggtcttacgtttcaaagtcctgctgatgctagggcttttgatagaggtatccgaagagctatagaggatatttctcaaggatgccccgaatcaaaaaatgaagctgaaggggcagatgacttacaagcaaatgaagaggattcttccagttctctagtgaaggatcacctttttcagcaagagacagttgttaccagtgagccttatagaagctcaaatataagaccttctccctttgaagatctgaatgccagaagagtctacatgcaaagccaagccaatcagataacatttggtcagccaggcttggacattcagagcagaagtatggaatacgtacagcggcaaatatccaaggaatgtggaagcctaaagtcccaaaatagggtccctttgaaatcaatcagacatgtcagctttcaagatgaggatgagattgtcagaataaaccctcgagatatcttaatacgtcgctatgcagactacagacatcctgacatgtggaaaaatgacttggaaagagatgatgctgattccagtattcagttttctaaaccagacagtaaaaaatcagactatctgtactcttgtggggatgagactaagttaagttcacccaaagactctgtggtatttaagacgcagccttcctcattaaaaattaagaagtcaaaacgaagaaaagaggatggtgaacgttctcgctgcgtatactgccaggaaaggtttaatcatgaagaaaatgttaggggaaaatgtcaggatgctccagaccctattaaaagatgcatatatcaagttagttgcatgctctgtgcagagagcatgttgtatcattgtatgtcagactcagagggagatttttctgatccctgttcgtgtgacactagcgacgacaagttctgcttgcgatggttagccctggtagctttgtctttcattgtaccatgtatgtgctgctacgtccctttgagaatgtgccatcgctgtggtgaggcatgtggttgctgtggtgggaaacataaagctgctggatgaaatggtccagtgccaaaatgagcttaaaatctttgtttccaggaattagctaacttggatttgtggaagcttttggcaagcaatatggaatcttgcctggtatcattgagcccacacatggaggaagcagaactcatcagttcttggcgtttcacgccatgcctaacttttcccttgagtgcatggcatgttttgttacaggttgtagagtatttgcagaaggaaaccatttctggttatttggctataaaaagtcagcataaaatatgatccaactaaaagggattaatttttggcatttttgtatatttatgcattaggtgatgggacttttaaaggtttgaatttattaggacacgaactaaaaataaaagtgcactaggggacagttgatttcaatctaagaaaagttaacacttgggaattacaagaagtaaaacaagtgcaactaaatcatttattagttgttttttgaaagcagttttatgtataaataacaaatgtttatatttaactaaatgtaaggtacgaattattacatattaaacttttcttccccttcctagttctgaagtagatatatatatatatatatctactgtcacattccatatattttgaatatttaactcatctagttaataatgtttttattccatgcgaatgatttgatattttcatccttatttctctttggctacaatttatattgagttatatctgtacattctggtaatctaaaatccttaaaaatactctaatagccttgagtgaccaactttttttttaaagcacagatgtaattgtctaatgttctgatgggaacgtaacacttatttttatataaaaagagactgagtaaacaaacattatagaaaaaaagtgaagttttttagttgttttttgtggtattcaaccagcaagttgttttctttcagagtttcctccttcaaaaagttatattgcatttacaaatgttttacaaggcagaaagtttgactggatagttagtgtaaaagcttcatgttgagatcttcacgtatcattctgctaaaccagaatatgttcagctgtgttactaatttttcagcttaatcctcagtgcttattatttacataacaataactttttatcagttacattttatttttatttaaactggccaaaagcaaaattattttatgttaaaatgtgtgctaaactatcccaggaaagtatttaatccaacattgtaaatgaagtatcttgtacatataaatttatttcttttgcagagcattatattactggatgtttaatttacaaaatagttgggtaaatgttccaacaaactttaaagtaccttgaagtcaaattgtctgtttttgttttgttgttgttgttgttgttttcttaagtgttacattaaaactctaaccaaggaaagggttctttaagaacattcccttagagggataaagttgagaagtgtgccttttttttaatggcttgaagtttcagaggtgataaaaattaaaatcacactactatttgaagctcattttctatgcaggtttttaaacgtcatttatgtatcattctttttatatatcacacttaagcttgtgttagcttttttcttttgccccagatcaaactgaacaatgtatataacactatctgtctgtaaaatactttttttaagaaagcatttatatttatatgacagcttgaactgacaacattgtgtatatagatcatcttgaagtattatttcacattgaaaagaagaaaatatattgataactatagatgttatgaagaagagggtatttctagttttgtactaaaaatcaattggatgaactaaatccaaaacatgacactgtaggcagcagttttaagtcttatttttactgtttatatatttgaatgctgctacaacagatgatcttcatccctgaagttttcagctaaacttggtttcctagaatagactgttaactttcaaaatttttattggtgaaatggaaatactgtttttccttgtgaatgaattttcatatttgtaagtgctaagtttataattcaggtttgatcaaggtgtgaataactgaagaaaataacttgctggctatataggaaaatgctgtggaaatgaactgtgtatatacttctgggaggaacaaatttaatcatttcttctgttaagcactaatcagtatagtgcaactcctggttctgtactgtattttatatgcaacatatatgctttaatattttaatgtttgtgcattaatattttcaatttgtttaaccactttgctgctaagattttgccgtcccattcccattttttcctttacaattttaaacaagtttcttcattaaaaactatggtgatgaaatggtttttattttaccttggatctttatagttaacatacccagtttcttaatcagtctacaagactaactgatgatataatgttctctgaatccctatatggaaattttcttttgagtaaatgagaattcctttgtgaaagcaaatgggtagtttaaatcactgattcttaaacatgtgtataggcaccttcaggaacattttctcattctctgtacagattcggcactgccaattggcttttcctctaaaacttttctttgtttttatctgatataagcagatggctcaagacaactgcttgagtaatagtattgaaaatggaatcatctagacggcatgacaagcaagactggtctgatgaacttgttcagaattgataattcttaaatatttctcttggcttcaaaagggacatcatttgatttctgaagaagtatgtcgtgtggagcttcagcaccacctactggatgatttccaggccagagacatgagatggcaatagggatctgacagggttcatcactactaccattaaagggctatttatgtggtgaccacctctaccagggaaaccaggaataagaactgtctcaaaggaattgtaaaatggttatttacctaatgtgtcttgttggcttgctgaaagattttaagcacttttttcttacatatcctgttttaaaatatttgttgatatttgggactggcaatcaaacttaatggatgtactgaggcatttatagaaccagttgctttaactctcaaaagccattaccaaaatggtatttttttcctccttccgccagtcagggagaatttttaaaaataataatcaaaacatgaaaaaacataatcacacctgtattttatcatgacagcttcagagagtgtgtgtgtacgtttttctctcttttatttgagacggagtttcactcttgttgcccaggctggagtgcaatggtgcgatctcagctcactgcaacctccgcctcctgggttcaagcgattctcctgcctcagcctcccaagtagctgggattacaggcacccaccaccatgcccagctaagttttggtattttagtagagatggggtttcaccatgttggccaggctggtcttgaactcctgaccttaggtgatccacccacctcggcctcccaaagtgctgggattacaggcatgagctactgcgcccagccgtgtgtatgtttctgaaatgatgatggggtggggttaaaatctaaagggaaaaacttgaaactacctattttcattggttattcagcagtgcctaaaatgagcttttgaagtaatgtaaatgcactttcaattcatgtgtatagtgccatctgatatcttgggtaagtcttgctttttcttttctttttcctctcccctgcccccttaattaaatggcacggaaatgtttcttaatatgcacgtgagtctccagagtacaggaaatgtgctttcctctaaatggtcaatgtaaagaatcttaaggatatttcttgtgttgaaatttacattcgattttgtgattacacttggaagtatgtgttaaattgggtttttaattgtagcccaaaggtgcattaagcaagtgtaacattttttccacataaaacttagaaaactttagttacctgaaaagcaaggattctttactaattattatgctcattcttgatttgacttccatgttcacacttcaaagtgtaagaggaagcactagaaactggcattattgttgcactaaaaaagtctataaatcataatagcaccatgaggtgttttgcaatgagacaaacatgaagaatgaatttctttaagagagaaacacaaccggaggtgatttatataaaccaaaagaaaaaaaaaggctttaaggtattaggtactgtttgcctagcagccaggtggttataaaagattcatatgctttggtacactgataaatgttagccattattcctgaaagcttcttaaattgcatcagttgttttgaaattttttcaagaataaactagttgaaaagtctttgtattaaaaatacacatagatttttgtgaacatttccagtgtgtagtgtcgtttgctttctatttctgacctcaaaagtgcctcacttgtatattatttccattaaaagcttgactgcattctttctaatgaacaatgaaaaactgtttaactcatgtcataatgtgtctcctcagatatagttaactagcttgatagttttgagtatataatgtaaataatacattataagtttgtaaccatttctgttacttcatacccgtgtaattggacatagcagatgattatcataagaatttgttttaatggtttttttccctcctggaattacctgattaaacctgtcatgaattataaaaggactttttcttattctcctagagcttatcaaattatcacataagagataattactggaggagaaagtaaaaatggaagcttttgataattagctctgttctttaaaagtatacttttaaactgaaagttcacatatagttcatcttaataacatatttattcatccttaattgtattcagatttttttttaagtctctaagctaataatgttatatttattggtttggtaacatgttgcagctaagctaatgaccttaagtggcaattgtttaacccaggactactgatttttttatattcaagtcagtttcatcgttttacttaactcgccatataaccaaaaataacgaataatctaaaggaaaggttattaggacagtaataaaaaattatagtgtatctcaacactagaataagttggattactatattatagtttatttgaaaaatcaaggagtaactgtatctttaccattaattatgaaatgtagtctcatgtgcttatttacaggtttttcagaatttgctttacattcttcacatcaagttaatacccacaagtaagtagaatagcttttataacaaggaaattgaaactagggttctagcttggctatcaatataagtgtcatgcacatagtgctccttaaagaaaaagacatcgacatcaatggtatgaaagctgtagtcactctttaaattgaactgctctaagatttgcagttttagtgagatctgaaatgatggttcaaaaaatacattcataataaaagtcttaacaaaatcaca

SEQ ID NO: 29925 - DNA, 4097 bp, Homo sapiens
tgcaccccttcccccaaaccctatcccgcgccctgcttccccttctgctgcggcgccctcttcatctctagccgccccccctccccaaatcaggcgatctccggagatgtgaagaaggggggcgagcggacaggaagatgaagggagcaaagctgcccgccgcgggacaggcgtctaggtgaacaagaaaatgaccgaagaaacacacccagacgatgacagctatattgtgcgtgtcaaggctgtggttatgaccagagatgactccagcgggggatggttcccacaggaaggaggcgggatcagtcgcgtcggggtctgtaaggtcatgcaccccgaaggcaatggacgaagcggctttctcatccatggtgaacgacagaaagacaaactggtggtattggaatgctatgtaagaaaggacttggtctacaccaaagccaatccaacgtttcatcactggaaggtcgataataggaagtttggacttactttccaaagccctgctgatgcccgagcctttgacaggggagtaaggaaagcaatcgaagaccttatagaaggttcaacaacgtcatcttccaccatccataatgaagctgagcttggcgatgatgacgtttttacaacagctacagacagttcttctaattcctctcagaagagagagcaacctactcggacaatctcctctcccacatcctgtgagcaccggaggatttataccctgggccacctccacgactcataccccacagaccactatcacctcgatcagccgatgccaaggccctaccgccaggtgagcttcccggacgacgacgaggagatcgtgcgcatcaacccccgggagaagatctggatgacggggtacgaggattaccggcacgcacccgtcaggggcaagtacccggacccctcggaggacgcggactcctcctacgtgcgcttcgccaagggcgaggtccccaagcatgactacaactacccctacgtggactcctcagactttggcctaggcgaggaccccaaaggccgcgggggcagcgtgatcaagacgcagccctcccggggcaagtcgcggcggcggaaggaggacggagagcgctcgcggtgcgtgtactgcagggacatgttcaaccacgaggagaaccgccggggccactgccaggacgcgcccgactccgtgagaacttgcatccgccgggtgagctgcatgtggtgcgcggacagcatgctctatcactgtatgtcggaccccgagggagactatacagacccttgctcgtgcgatactagcgacgagaagttttgcctccggtggatggctcttattgccttgtctttcctggccccctgtatgtgctgttacctgccccttcgggcctgctaccactgcggagtgatgtgcaggtgctgtggcgggaagcacaaagcggccgcgtgactcagtttccctcccttctccctccatccgcagccacaggggaactcgtctcttacatactctcatcttctcccccgctcccttccactccaaggagcgaggagggcaagcggcctcccagctccctggtacctcgaggcaccattccagccagggacgctgccgggtagactctccactccccctgccgcccacactgcagcagccacatccatacacacacgctcgcacagtgttctgaggaaggaaccttcgccacagactcctgtactattaacaatctgtaaccaagctaactgtctcatccatgtgttgatttcctgtttcctcctcccccgcctcttccagttcaaaggagtctgcaattggaactgctgattttcggtgggttttgtagttgatttttccaagagcgtcgaagactctctttctcttggttcaccttgcctgtcgctagcaagcatctggttcagcggaaatgggatgtgagaatgatgaaacccgacagaagtatctcagcctgcagtcagttattatgtataggaggtgagctagttaacaaacttgtaccacaaaacaatatcgctttaacttttctaaagccaaatttcccatgtaagctgcagtttctatctttagcccatcatcattttctgcccccccaaaatctgttgaaatgattcactgatgcaaaacattcacccgtaatagactgagaattgagccttaacttcagattaacttgtgagaatcaggaaaattccttcaactgcattgcatcctcttggaccagggctagaatggggatttcaggtttctatgagcctccccattacccctaaagtagaacattttttaaattgtgttgccaccacttctaaaaatttagcaatattagaataggatactagtgaagtaagaaattttgcttgttgttttgcaaaccaaatagtttcctcaaacacaaatcagtgttcccacgaacaagttccagttgagaaacactaaggttatggtgaataaaaccatagggagcttcttccccccaacccctggctattttatattaatggggagaggggatttttaaatgtcataaatttgaagagtggtgggttgcattttcttcatgggtttatgttttcgtttcattttggactcaatttcacatcaccaaattcctcatttatacttggggaaaaaacaaggccatatgtaaaaacccttccaatgcctaagtgtctttctcctgcaactccaaacccagactcgccactttgggtgcacaggtggttaggtcagccaactggttctgcctgtcgccttgccacggaggaggcttctaattagctggaaaagagtatttttctaatacgttgcaaggattagccaaatcttcttattgaagaaagaagaaaagtgaagagtggttacctatacctagcatagtacaatcagaacctcgtggagaccaccggggacaggcttgcggacgccggctgttcttcccgccacgatctttctgtggtagcggccagcagaagacatggcctgctccccactccctttccccactccttctttattgcacacaggacaccagtcttcaaggaaagggacttttttccagtctgccaatcatattgggaaagtgctagctgtgctcaccttcatggggctgtttccagctcgtccacaagctcatcgattttctttagtagattaccggtgtaaatacccagtgtgcttatgagtcagttagtagacgtcttcattcattggagtaactggtttaggctttccagtttggaaaaggagcagagagctgtccatctggattgatggaagaaaagagaacctcatccatgcctggagaacatctagaaaaccttcagccagcctccagtgctgtcgagagaccaccttcccccgacccggaggcacttccttggggtctttctctagggtctcttctctacaaagcacaacactaatgttcgtttccttagacctcagttcaagtgcccctatttatttcaataagaacgcacatatcccagctgttttttgtttgtcacctctatttagttgttacctgtttctctcttctttcaccccttgtccttttccacccttttaagagttacgctagcagatcttactccacgtatactttttggtttgtgaaggcatcggttaagggcacaaagacagccatggggacatttatgtaaatacgtctctaattgccacactgcagctgaacagtgtgtagtattttcccagtcagctttgccatactgacgtcaatcatttgagagaaattattcagattttatttttgtatctgtggtaacaaaacattaaccaaaagattttctgtccagaagcctccccgaccccccaagctatttgctcacattaacaaattaaagtgcctgaagcataattcattctttacctgtatactaaaaaccctgttgtattgatttttttataataagcctttttacctctgtgtaaaaaatatatatacaagtgtatgatgtacattttagttcttaacttttttttatggtttctaatatgtatgaccaatgtagccattgctttaaaatgtaccgtgtaaatataaacacatcctatcaga

SEQ ID NO: 29926 - DNA, 555 bp, Homo sapiens
cttctccctttttttcggtcgcaagtaggaagctttttgcactccaccacctctggccgctgggaagacgtcatcgcttccgccctacttcctcctcctgttggcggcggcgatctccggagatgtgaagaaggggggcgagcggacaggaagatgaagggagcaaagctgcccgccgcgggacaggcgtctaggtgaacaagaaaatgaccgaagaaacacacccagacgatgacagctatattgtgcgtgtcaaggctgtggttatgaccagagatgactccagcgggggatggttcccacaggaaggaggcgggatcagtcgcgtcggggtctgtaaggtcatgcaccccgaaggcaatggacgaagcggctttctcatccatggtgaacgacagaaagacaaactggtggtattggaatgctatgtaagaaaggacttggtctacaccaaagccaatccaacgtttcatcactggaaggtcgataataggaagtttggacttactttccaaagccctgctgatgcccgagcctttgacaggggagtaagga

SEQ ID NO: 29927 - DNA, 1800 bp, Homo sapiens
aataatgctaatacccagcactcgggctccacaatgtagaggaaatggcatcgcctggcagtgacagctatattgtgcgtgtcaaggctgtggttatgaccagagatgactccagcgggggatggttcccacaggaaggaggcgggatcagtcgcgtcggggtctgtaaggtcatgcaccccgaaggcaatggacgaagcggctttctcatccatggtgaacgacagaaagacaaactggtggtattggaatgctatgtaagaaaggacttggtctacaccaaagccaatccaacgtttcatcactggaaggtcgataataggaagtttggacttactttccaaagccctgctgatgcccgagcctttgacaggggagtaaggaaagcaatcgaagaccttatagaaggttcaacaacgtcatcttccaccatccataatgaagctgagcttggcgatgatgacgtttttacaacagctacagacagttcttctaattcctctcagaagagagagcaacctactcggacaatctcctctcccacatcctgtgagcaccggaggatttataccctgggccacctccacgactcataccccacagaccactatcacctcgatcagccgatgccaaggccctaccgccaggtgagcttcccggacgacgacgaggagatcgtgcgcatcaacccccgggagaagatctggatgacggggtacgaggattaccggcacgcacccgtcaggggcaagtacccggacccctcggaggacgcggactcctcctacgtgcgcttcgccaagggcgaggtccccaagcatgactacaactacccctacgtggactcctcagactttggcctaggcgaggaccccaaaggccgcgggggcagcgtgatcaagacgcagccctcccggggcaagtcgcggcggcggaaggaggacggagagcgctcgcggtgcgtgtactgcagggacatgttcaaccacgaggagaaccgccggggccactgccaggacgcgcccgactccgtgagaacttgcatccgccgggtgagctgcatgtggtgcgcggacagcatgctctatcactgtatgtcggaccccgagggagactatacagacccttgctcgtgcgatactagcgacgagaagttttgcctccggtggatggctcttattgccttgtctttcctggccccctgtatgtgctgttacctgccccttcgggcctgctaccactgcggagtgatgtgcaggtgctgtggcgggaagcacaaagcggccgcgtgactcagtttccctcccttctccctccatccgcagccacaggggaactcgtctcttacatactctcatcttctcccccgctcccttccactccaaggagcgaggagggcaagcggcctcccagctccctggtacctcgaggcaccattccagccagggacgctgccgggtagactctccactccccctgccgcccacactgcagcagccacatccatacacacacgctcgcacagtgttctgaggaaggaaccttcgccacagactcctgtactattaacaatctgtaaccaagctaactgtctcatccatgtgttgatttcctgtttcctcctcccccgcctcttccagttcaaaggagtctgcaattggaactgctgattttcggtgggttttgtagttgatttttccaagagcgtcgaagactctctttctcttggttcaccttgcctgtcgctagcaagcatctggttcagcggaaatgggatgtgagaatgatgaaacccgacag

SEQ ID NO: 29928 - DNA, 1419 bp, Homo sapiens
aagttggaggggagatgagggttgagggaacattccatgggagagcagggtttgagctcatgactgtgttgtccctgtccttccccccacctcctgcaggtacatggtgcgggtccgagctgtggtgatggcccgagatgactccagtgggggctggctgcctgtggggggcgggggcctcagccaggtgagcgtgtgtcgggtccgaggggccaggcccgaggggggggcccgccaggggcactacgtcatccacggggaacgcctccgggaccagaaaacaaccttggagtgtacactgaagccaggcttggtttacaacaaggtgaatcccatctttcaccactggagcctgggtgactgcaagtttggactgacgtttcagagccctgcagaggctgatgagttccagaagagcctgctggctgcgctggccgcactgggtcgaggctcactcaccccctcctcctcctcctcctcctcctctccttcccaggatactgcagagaccccctgccctctgacgtcccacgtggacagcgactcctcctccagtcacagccgccaggagactcctcccagcgccgctgcggcccccatcatcacgatggagtcagcttcaggcttcgggccgaccacgcccccccagcgccgccgctcctccgctcagagctaccctccgcttctaccgttcacggggattccggaaccctcagagcccctggcaggggcagggggcctggggtggggcggccgcggctacgaggattaccggcgctccgggccacccgcgcccctcgccctgtccacctgcgtcgtgcgcttcgccaagaccggcgcgttgaggggcgctgccctgggtcccccagcggcactacctgcccctttgaccgaggctgcgcccccagcgccccccgctcgcccaccccccggcccgggcccatcctctgcgcctgccaaggcctccccggaagcggaggaggcagcgcgctgcgtgcattgccgcgcgctcttccgtcgcagagcagacgggcgtggcggccgctgcgcagaggccccggacccgggtcgcctcctggtgcgccgtctaagctgcctgtggtgcgccgagagcttgctctaccactgcctgtcggacgccgagggcgacttctcggacccgtgcgcctgcgagccgggccacccgcgccccgccgcgcgctgggccgcgctggccgcgctctccctggcagtgccctgcctctgctgctacgcgcccctgcgcgcgtgccactgggtcgcagcgcgatgcggctgcgccggctgcgggggtcgccacgaggaggctgcgcggtgaggacggcctggtgggtcccctagccggcccgaggacccaaaattgagggtccaggaccccggactccgttcggacctaaaacc

SEQ ID NO: 29929 - DNA, 543 bp, Homo sapiens
gtacatggtgcgggtccgagctgtggtgatggcccgagatgactccagtgggggctggctgcctgtggggggcgggggcctcagccaggtgagcgtgtgtcgggtccgaggggccaggcccgaggggggggcccgccaggggcactacgtcatccacggggaacgcctccgggaccagaaaacaaccttggagtgtacactgaagccaggcttggtttacaacaaggtgaatcccatctttcaccactggagcctgggtgactgcaagtttggactgacgtttcagagccctgcagaggctgatgagttccagaagagcctgctggctgcgctggccgcactgggtcgaggctcactcaccccctcctcctcctcctcctcctcctctccttcccaggatactgcagagaccccctgccctctgacgctctcccagtacttcaggcatatgctgtgcccttgacagtggccctaaccgcatccttatgaataggtactcttaggatccccgttttacagaggaggaaactgaggctcaaagag

SEQ ID NO: 29930 - DNA, 2961 bp, Homo sapiens
agacgcgtggagcctggcggcgagtgggggcgtgcgacggttactctggttactggggccgcgccgcgctggcgagagccgccgcccgcgagggatgctggtgaggaagccgtcgggagccgccgccgccatctgagggaggtaccctggaaaccaccttttatcggtggggaagtgcagtcgcggtgggcggctctgggggccagcgaaacgggaggcctctaaatctttaggttggggctgcattgccctggagccgcactcttgagtccgaggccatcttttgttggagaaggcgtcggcgttggcgttttcccgaggttgggctgtacagtgtctccgtccgcggaaaaagaagcctctgaacccgcgccggcccgcagcccccgtgccttccggccgctgctcgccgtcgccagaggctaggccacgtttcccccagtgccgaggtgtttctgtgaccctccctccactcccattcccttctgaaagggcacctgctcttggtgagaaaagaaattatagcacgaagagccagtatcagaagagtatccatcacccgcagcaaccgctcagggaacaccatcaaaaaagaaaaaaagggaatatctggatttcctgggcgaggaggagcgagtctgctcgggagctgttccagcaggcgatttttaaatactgctttctacgccctatacaacttggcttcacatacttttacactaactttatatgatttttaaaaactggtctgatcggacttctcgtcctgggacactgtttactggagtctggccggctctccgtgctcctcttggtacctcattttggggagaaccttaaacccactcgagcagataatctccgccttgaccggtgccaccaaagaagccttggaaccatgtggacttttctgggcattgccactttcacctatttttataagaagttcggggacttcatcactttggccaacagggaggtcctgttgtgcgtgctggtgttcctctcgctgggcctggtgctctcctaccgctgtcgccaccgaaacgggggtctcctcgggcgccagcagagcggctcccagttcgccctcttctcggatattctctcaggcctgcctttcattggcttcttctgggccaaatccccccctgaatcagaaaataaggagcagctcgaggccaggaggcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaatgcaaagtttattgaaggtgttgtgttacagttattagaggaagatgatgttgtgatgggagttcagtacaaggataaagagactggagatatcaaggaactccatgctccactgactgttgttgcagatgggcttttctccaagttcaggaaaagcctggtctccaataaagtttctgtatcatctcattttgttggctttcttatgaagaatgcaccacagtttaaagcaaatcatgctgaacttattttagctaacccgagtccagttctcatctaccagatttcatccagtgaaactcgagtacttgttgacattagaggagaaatgccaaggaatttaagagaatacatggttgaaaaaatttacccacaaatacctgatcacctgaaagaaccattcttagaagccactgacaattctcatctgaggtccatgccagcaagcttccttcctccttcatcagtgaagaaacgaggtgttcttcttttgggagacgcatataatatgaggcatccacttactggtggaggaatgactgttgcttttaaagatataaaactatggagaaaactgctaaagggtatccctgacctttatgatgatgcagctattttcgaggccaaaaaatcattttactgggcaagaaaaacatctcattcctttgtcgtgaatatccttgctcaggctctttatgaattattttctgccacagatgattccctgcatcaactaagaaaagcctgttttctttatttcaaacttggtggcgaatgtgttgcgggtcctgttgggctgctttctgtattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcaatttaaaatgaaggggttaaataagttagacatttaaaagaaatgattgttaccataaattagtgctaatgctgaggagaactacagtttttcttttgaatttagtatttgagatgagttgttgggacatgcaaataaaatgaagaatgaa

SEQ ID NO: 29931 - DNA, 1879 bp, Homo sapiens
agctggctgagacgcgtggagcctggcggcgagtgggggcgtgcgacggttactctggttactggggccgcgccgcgctggcgagagccgccgcccgcgagggatgctgcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaatgcaaagtttattgaaggtgttgtgttacagttattagaggaagatgatgttgtgatgggagttcagtacaaggataaagagactggagatatcaaggaactccatgctccactgactgttgttgcagatgggcttttctccaagttcaggaaaagcctggtctccaataaagtttctgtatcatctcattttgttggctttcttatgaagaatgcaccacagtttaaagcaaatcatgctgaacttattttagctaacccgagtccagttctcatctaccagatttcatccagtgaaactcgagtacttgttgacattagaggagaaatgccaaggaatttaagagaatacatggttgaaaaaatttacccacaaatacctgatcacctgaaagaaccattcttagaagccactgacaattctcatctgaggtccatgccagcaagcttccttcctccttcatcagtgaagaaacgaggtgttcttcttttgggagacgcatataatatgaggcatccacttactggtggaggaatgactgttgcttttaaagatataaaactatggagaaaactgctaaagggtatccctgacctttatgatgatgcagctattttcgaggccaaaaaatcattttactgggcaagaaaaacatctcattcctttgtcgtgaatatccttgctcaggctctttatgaattattttctgccacagatgattccctgcatcaactaagaaaagcctgttttctttatttcaaacttggtggcgaatgtgttgcgggtcctgttgggctgctttctgtattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcaatttaaaatgaaggggttaaataagttagacatttaaaagaaatgattgttaccataaattagtgctaatgctgaggagaactacagtttttcttttgaatttagtatttgagatgagttgttgggacatgcaaataaaatgaagaatg

SEQ ID NO: 29932 - DNA, 1799 bp, Homo sapiens
gataatctccgccttgaccggtgccaccaaagaagccttggaaccatgtggacttttctgggcattgccactttcacctatttttataagaagttcggggacttcatcactttggccaacagggaggtcctgttgtgcgtgctggtgttcctctcgctgggcctggtgctctcctaccgctgtcgccaccgaaacgggggtctcctcgggcgccagcagagcggctcccagttcgccctcttctcggaatgacccagagatggaagaaaggtgacagtcattgagagagacttaaaagagcctgacagaatagttggagaattcctgcagccgggtggttatcatgttctcaaagaccttggtcttggagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaatgcaaagtttattgaaggtgttgtgttacagttattagaggaagatgatgttgtgatgggagttcagtacaaggataaagagactggagatatcaaggaactccatgctccactgactgttgttgcagatgggcttttctccaagttcaggaaaagcctggtctccaataaagtttctgtatcatctcattttgttggctttcttatgaagaatgcaccacagtttaaagcaaatcatgctgaacttattttagctaacccgagtccagttctcatctaccagatttcatccagtgaaactcgagtacttgttgacattagaggagaaatgccaaggaatttaagagaatacatggttgaaaaaatttacccacaaatacctgatcacctgaaagaaccattcttagaagccactgacaattctcatctgaggtccatgccagcaagcttccttcctccttcatcagtgaagaaacgaggtgttcttcttttgggagacgcatataatatgaggcatccacttactggtggaggaatgactgttgcttttaaagatataaaactatggagaaaactgctaaagggtatccctgacctttatgatgatgcagctattttcgaggccaaaaaatcattttactgggcaagaaaaacatctcattcctttgtcgtgaatatccttgctcaggctctttatgaattattttctgccacagatgattccctgcatcaactaagaaaagcctgttttctttatttcaaacttggtggcgaatgtgttgcgggtcctgttgggctgctttctgtattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcaatttaaaatgaaggggttaaataagttagacatttaaaagaaatgattgttaccataaatt

SEQ ID NO: 29933 - DNA, 4004 bp, Homo sapiens
agttgtgacggaacgcatgccattataatgagtttttatatctggtgggagcttttacagggtataaaataatgtgaatttagtgtatgtggagattttcctgttatctaagttcccagtttctctttcaatggcaagaaaacgggtttttgataaggcgcgcgccgcgggcagcttctgcctcagcgggtcttcggcggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggaggaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcttgagaaagtccacagtcttttccggcgacagttggcgatcccactctatgatatggaggccacatttgcagagtatgaagaatggtcagaagacccaataccagagtcagtaattcagaactataacaaagcactacagcagctggagaaatataaaccctatgaagaagcactgttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctgtaaccttcgagaaagctttgaatgccggcttcatccaggccactgattatgtggagatttggcaggcataccttgattacctgaggagaagggttgatttcaaacaagactccagtaaagagctggaggagttgagggccgcctttactcgtgccttggagtatctgaagcaggaggtggaagagcgtttcaatgagagtggtgatccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggatgatgagaaagagtggggcgatgatgaagaagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccggagaccaggaaggcaccaggtggccccatgcttttgccgcagacatacggagcgagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagccattgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagctttattaaactgacgttctcttcaaaacttcttgctgaatggtactcagatgtgcattcacatacagatgtgttttgaagtgggtgtaccttgctttacctaatagatgtgtaaatagaacttttgtaagtc

SEQ ID NO: 29934 - DNA, 2252 bp, Homo sapiens
attagaagcgcaagatggcgactgcggccgaaacctcggcttcagaacccgaggctgagtccaaggctgggcccaaggctgacggagaggaggatgaggttaaggcggctaggacaaggaggaaggtgttatcgcgggctgtggccgctgcgacatacaagaccatggagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcttgagaaagtccacagtcttttccggcgacagttggcgatcccactctatgatatggaggccacatttgcagagtatgaagaatggtcagaagacccaataccagagtcagtaattcagaactataacaaagcactacagcagctggagaaatataaaccctatgaagaagcactgttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctgtaaccttcgagaaagctttgaatgccggcttcatccaggccactgattatgtggagatttggcaggcataccttgattacctgaggagaagggttgatttcaaacaagactccagtaaagagctggaggagttgagggccgcctttactcgtgccttggagtatctgaagcaggaggtggaagagcgtttcaatgagagtggtgatccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggatgatgagaaagagtggggcgatgatgaagaagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggc

SEQ ID NO: 29935 - DNA, 2834 bp, Homo sapiens
gcaagatggcgactgcggccgaaacctcggcttcagaacccgaggctgagtccaaggctgggcccaaggctgacggagaggaggatgaggttaaggcggctaggacaaggaggaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcttgagaaagtccacagtcttttccggcgacagttggcgatcccactctatgatatggaggccacatttgcagagtatgaagaatggtcagaagacccaataccagagtcagtaattcagaactataacaaagcactacagcagctggagaaatataaaccctatgaagaagcactgttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctgactccagtaaagagctggaggagttgagggccgcctttactcgtgccttggagtatctgaagcaggaggtggaagagcgtttcaatgagagtggtgatccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggatgatgagaaagagtggggcgatgatgaagaagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccggagaccaggaaggcaccaggtggccccatgcttttgccgcagacatacggagcgagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccg

SEQ ID NO: 29936 - DNA, 1758 bp, Homo sapiens
cgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctgactccagtaaagagctggaggagttgagggccgcctttactcgtgccttggagtatctgaagcaggaggtggaagagcgtttcaatgagagtggtgatccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggatgatgagaaagagtggggcgatgatgaagaagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccggagaccaggaaggcaccaggtggccccatgcttttgccgcagacatacggagcgagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacagg

SEQ ID NO: 29937 - DNA, 1184 bp, Homo sapiens
cttctgtccgaagttgtgacggaacgcatgccattataatgagtttttatatctggtgggagcttttacagggtataaaataatgtgaatttagtgtatgtggagattttcctgttatctaagttcccagtttctctttcaatggcaagaaaacgggtttttgataaggcgcgcgccgcgggcagcttctgcctcagcgggtcttcggcggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggaggaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcaggtgggcccgggggtgggcagcgggcatcttccagtctttcaggtcctcgggtccccatgtcctggcccgcctccctagtcctcggcggcgataaagccgccaaggctgcaaacccgcttttcgtgacagtagctcctgtcggatttgagtgcttactgcctgcccattgccttgcaaacgttatctcattgaatcctcgccacgaccctgtgaaggaagccctgttatctatccccattttactggaggaaactgaggctcgtggaggaaagtttcttgctcaagataacacttcctgcaagtcaggccttgtactttgatcccattccagaactcccactcttaaccacacgtccaacagtagaaataaactcattcgcaagagagtgttattttgttatgtaggaatgacggcgatgatgaaacttgtggtaagaaaaatattgaccgcgatggtgataatagaaatggaaaggtttctggttctggaggttaaggcctcagttctagctgttcaactcttgtatgtgcttgtaagaatttcttaatttctctcaccctctcgacttccttatctgcagattgggagcaacaatttctgcataatataattgttgtaacagtaa

SEQ ID NO: 29938 - DNA, 408 bp, Homo sapiens
ggggccgcgacctcggctcgagaaggtgctttagtctgaagatggcggcctcagcagcgagaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcagcctattaataaagttaacataactgagaa

SEQ ID NO: 29939 - DNA, 1462 bp, Homo sapiens
gcgccgccgggacgggcacgggcgcgcgggctccggcgggcgccggctgccttcctccgtcgctcgctgtctctcccggccgcattctcctccgctgcggggccgagctctccccagcgctcgcaggaaggaagaagggagccgaggacgccgagaagttcccgcggcagccgcggatcccggccaaggcggaggctgcggctccgacggggcaggagcgcgatccacggcgaggggcgtacggccaaagggtccgcggcgtggagcgctcggaccttccgctctcccccgggcgtgggccgggaccccatgagacgcgcccacgaggggcgcgagattcctagcttgggcggcgctaggcggagggaggtgttgcagccgccggagccagagagctgccggcaggaggcggcggcggcaagaacttgaacttggcgtcgggagcgggcgccccggacgccccccgccggggccggggcgccgagggacctgcgccgcagcgctgccccccgaatggccgcggcggcggaccgggctcccgcgccgcggccctaggcggcctctcgccatggccaagtggctaaacaagtacttcagcttgggcaacagcaagaccaagagccccccgcagccgccgcggccagactaccgcgagcagcggcgccgaggcgagcggccttcgcagcccccccaggccgtgccgcaggcctcctccgccgcctcggcgtcctgcggtccggccaccgcctcctgcttctcagcctcttcgggctcgctgcccgacgacagcggcagcaccagcgacctcatccgcgcctaccgcgcgcagaaggagcgagacttcgaggacccctacaacgggcctggctcgtcgctgcgcaaactgcgcgccatgtgccgcctggactactgcggcggcagcggggagccaggcggggtccagcgcgccttctcggcctcgtccgcgtcgggcgccgcgggctgttgctgcgcctcctcgggcgcgggggccgccgcgtcctcgtcctcgtcctccggctctccgcatctctaccgcagcagcagcgagcggcggcccgccacgccggccgaggtgcgctacatctcccccaagcaccgcctcatcaaagtggagagcgccgcgggcggtggggccggggaccccctggggggcgcctgcgcgggcggccgcacctggagcccgacggcctgcggaggcaagaaactgctcaacaagtgcgccgcctcagccgcggaggagagcggggccggcaagaaggacaaggtgaccatagccgatgactactcagatccctttgatgccaagaatgatctcaagagcaaagcaggaaagggggagagtgctggctacatggagccctatgaggcacagaggatcatgacaggtttacaggaagcatggagacattcccccagtggctgttttcctgttggcccttga

SEQ ID NO: 29940 - DNA, 2783 bp, Homo sapiens
gccgccgggacgggcacgggcgcgcgggctccggcgggcgccggctgccttcctccgtcgctcgctgtctctcccggccgcattctcctccgctgcggggccgagctctccccagcgctcgcaggaaggaagaagggagccgaggacgccgagaagttcccgcggcagccgcggatcccggccaaggcggaggctgcggctccgacggggcaggagcgcgatccacggcgaggggcgtacggccaaagggtccgcggcgtggagcgctcggaccttccgctctcccccgggcgtgggccgggaccccatgagacgcgcccacgaggggcgcgagattcctagcttgggcggcgctaggcggagggaggtgttgcagccgccggagccagagagctgccggcaggaggcggcggcggcaagaacttgaacttggcgtcgggagcgggcgccccggacgccccccgccggggccggggcgccgagggacctgcgccgcagcgctgccccccgaatggccgcggcggcggaccgggctcccgcgccgcggccctaggcggcctctcgccatggccaagtggctaaacaagtacttcagcttgggcaacagcaagaccaagagccccccgcagccgccgcggccagactaccgcgagcagcggcgccgaggcgagcggccttcgcagcccccccaggccgtgccgcaggcctcctccgccgcctcggcgtcctgcggtccggccaccgcctcctgcttctcagcctcttcgggctcgctgcccgacgacagcggcagcaccagcgacctcatccgcgcctaccgcgcgcagaaggagcgagacttcgaggacccctacaacgggcctggctcgtcgctgcgcaaactgcgcgccatgtgccgcctggactactgcggcggcagcggggagccaggcggggtccagcgcgccttctcggcctcgtccgcgtcgggcgccgcgggctgttgctgcgcctcctcgggcgcgggggccgccgcgtcctcgtcctcgtcctccggctctccgcatctctaccgcagcagcagcgagcggcggcccgccacgccggccgaggtgcgctacatctcccccaagcaccgcctcatcaaagtggagagcgccgcgggcggtggggccggggaccccctggggggcgcctgcgcgggcggccgcacctggagcccgacggcctgcggaggcaagaaactgctcaacaagtgcgccgcctcagccgcggaggagagcggggccggcaagaaggacaaggtgaccatagccgatgactactcagatccctttgatgccaagaatgatctcaagagcaaagcaggaaagggggagagtgctggctacatggagccctatgaggcacagaggatcatgacagaatttcagaggcaggaaagtgtccggtcccagcataaaggtatccagttatatgacaccccttacgaacctgaaggccaaagtgttgactcagactcggagagcacagtcagcccccgactgcgggagagcaagctgccccaggatgacgacaggcccgccgatgagtacgaccagccttgggagtggaaccgggtcaccatcccagccctggcagcacagtttaatggcaacgagaagcggcagtcatccccctcaccttcgcgggaccggcggcgccagcttcgtgcccctggagggggctttaagcctatcaaacatgggagccctgagttctgcgggatcctaggagaaagggtggatcctgccgtccccctggagaagcaaatatggtatcacggagccatcagcagaggagacgccgagaacctgctgcgactctgcaaggagtgtagctaccttgtccggaacagccagaccagcaagcatgactactccctctccctgaggagcaaccagggttttatgcacatgaaactggccaaaaccaaagagaaatacgttctgggtcagaacagccctccgttcgacagtgtcccggaagtcatccactactacaccaccagaaagctacccatcaaaggggctgagcacttgtccctcctctatcccgtggctgtgaggaccctgtgagcggaccagacctgccctgctctgtgacagagcctgagacttggaggtgccagaggccccccaccaaccagcccagccactgttgctggctgtgtcgtttgtgttgtgtgtatggtactagcacaccactgcatgtctctagaatgctgttgccacttacgggggctggagaaggcctggataaagacagaagggcggcaacacaccaccccagcccccacccccaccctctccttgagtttctgtgaattaaaatatttgcaaatccaaagagatgccttccaggatgaacaaaggcagaccagctccgaggggcggggtagggtggggcgggagctccctggctgacatctctttgttctccagctgtctcaaattcacacctctgtacagggcaaagttttcccacaggagcccccctactgatgctgggagccaaatgctggtgctttgagagtcccggaggccccggggttcccgccccgctggtgtgtatatgtgtgtctgtgtgagtgtgtgtgtgagtacagatgtgagaaggtggtcacacacagatgggtaagcccactgatctacttgtagtcactcagtgtaatcattaggctatcttcaaggaatcattgtgcagtcaaaaagaggattcaattatttatgaatagggtgtgtaaataaaatagtcatttaata

SEQ ID NO: 29941 - DNA, 1576 bp, Homo sapiens
ggcgaccgcggctgaggtacaggtgcctcgcggtgcagccgggtcgccttccagcccgtccgcctcccgaccagggcccgcgccccgtcccgcctctctcccgcccagccaaatgcaggccgccgccctccctgaggagatccgttggctcctggaagatgctgaagagtttctggcagaaggtttgcggaatgagaacctcagcgctgttgcaagggatcacagagaccatattctacggggctttcagcaaatcaaagccaggtactattgggattttcagccccaagggggagacattggacaggacagctctgatgataatcacagcgggactcttggcctgtccctcacatccgatgcaccctttttgtcagattatcaggatgagggaatggaagacatcgtaaaaggagctcaagaacttgataacgtaatcaagcaaggatacttggagaagaaaagcaaagatcatagtttctttggatcggagtggcagaagcgatggtgtgttgtcagcagaggtctcttctactactatgctaatgagaagagcaagcagcccaaagggaccttcctcattaagggctacggtgtacggatggccccccacctgcgaagagattccaagaaagaatcctgctttgaactgacctcccaggataggcgcagctatgagtttacagctactagtccagcagaagccagagactgggtggatcaaataagtttcttgttaaaggatctgagctccttaaccattccatatgaagaggatgaggaggaagaagaaaaagaagagacatatgatgatattgatggttttgactccccaagttgtggttcccagtgcagacccactatcttgcctgggagtgtggggataaaagagcctacagaggagaaagaagaagaagatatttatgaagtcttgccagatgaagagcatgatctagaagaggatgagagtggcactcgacgaaaaggagtagactatgccagttactaccagggcctatgggattgccatggtgaccagccagatgaactgtccttccaacggggtgacctcatccgtattctgagcaaggagtataacatgtatggctggtgggtgggagaactgaacagcctcgttgggattgttccaaaggagtatctcaccactgcctttgaagtggaagaaagatgaaacccaggaaatatattcttccctctctcctgcctttatgaggaaactgatcatcaaaagttcccactccctacttctgccaccccaccaacgccttggactcctctctttgctgaagagacccaagtctcttgacacctcagagtgactgtaagctaccagtaagacaagtgggaagaggcacgttcatcaaacctgttactaaaccagcctagtcatagctcatccccatctctaaatgtgtccacacaaccacatctgccttttccacaagcttttcacaaagaaggtgagagagaaggaaaccttgggaggaggacattactggttgttctggctggtttgaaaagcacaaataaacttgggatgtggttccttgccatg

SEQ ID NO: 29942 - DNA, 3447 bp, Homo sapiens
cacacacacactggaaactcctgcatactcctcttactataatctgtcaccaaagactggatattcctgtgctggggctcgtgccagcgcctcgggctgccaggtgctgctttccaactcccacatgggctgccctccccctactgctacccacagggcccccactccacctgctcccagacgaggccaactcctggccaagcttaggggcacagcggaggcgctctgtttctgatttttctcgccttccttggagatgcctgtgcttggaagggaaggcagaacattgcatcttggaacaaatctgcttttgatcatgcaaatgaatgcctggataatgtaggcagactgtcaatttcaccagttagaaagaaagagaaaagggggagaaattccccatgacagcgactgatgaagaatttcaatagaaagctgctacttcagaaaataagatcatttgctgcgaatggagaacatctcaggcagccctgatgctccaccgtccttgcagagagaagcttgctcagagtggttactgaaaacaggaacctgcccttctgcaagccctgtgccttcctcgttcctagcagaggaagtatgcggccagtttagcaactgcagttcttctgtgtagcatgggctgcttctccacaaccgcgagaagcccggctgcctgtttattctggagcagcagcagttgacagacggagaggcagtgactctgcacccagcaatccctctgcagacagctcccacaggagtcatgcccagtgtgtgaaggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccccgatattccgccgaggggagaaactgcgtgtgatttctgatgaagggggctggtggaaagctatttctcttagcactggtcgagagagttacatccctggaatatgtgtggccagagtttaccatggctggctgtttgagggcctgggcagagacaaggccgaggagctgctgcagctgccagacacaaaggtcggctccttcatgatcagagagagtgagaccaagaaagggttttactcactgtcggtgagacacaggcaggtaaagcattaccgcattttccgtctgcccaacaactggtactacatttccccgaggctcaccttccagtgcctggaggacctggtgaaccactattctgaggtggctgatggcctgtgctgtgtgctcaccacgccctgcctgacacaaagcacggctgccccagcagtgagggcctccagctcacctgtcaccttgcgtcagaagactgtggactggaggagagtgtccagactgcaggaggaccccgagggaacagagaacccgcttggggtagacgagtcccttttcagctatggccttcgagagagcattgcctcttacctgtccctgaccagtgaggacaacacctcctttgatcgaaagaagaaaagcatctccctgatgtatggtggcagcaagagaaagagctcattcttctcatcaccaccttactttgaggactagccaagaacagacacaatggttcatgcccaaaaggaacagaagttccaactattgcctgggatcttgcgaaaagcgaggttccctgatccctgggagcctcacgtattttagaagccaagagaagccacatggagactcaaattcgcatcttctctatccacatcatgaccaaaggaacccctccctggtgtctgatcagggctgtggcatcacgaaacattggatcatgacatgtcgggcgatgcttggaagagcccagcatgtatgtatgcacacattgtgtgtgtgggaaggacaaagccactctcacaagaaagggcaccaggactgctctccaaggaactggacctgtccagacagttacactccaaggtcattggagagaacttctgtatgggcaagcctgagagggagaggaaacaaaagctgtgtcctggcagaaggtctgggtttgcagatgggtgccctgaatggaactactttaactaatccatagggacttctggtatgctttcctctctttttaaaggaacttcgtgacactaaacattagcccaaaggacttcttagccttcaattgggagatacctttggtctgctcctgcaccaaagccatatgggtggaagtcagttggcctccctggttctgcagagggccagaagaatgagagagaggaagactgctggcagggaaatcgaggaggcgagactagaactgcaccagcttccctgatgtctgcagccatggctttgcagcgcagacagagcttctctgggatgctgggattcttgcctgtatgaatgcatcaagtattcatttattgcccgaataggcattgcattaagtcctctgtaaggtgtcaggcaagccaaaaaaaaaaaaaagatgcgtaagtcctaacccccaacagaggtgttcacagtgtagacagggaaaaaatgtataaacaaatgtgtaaaaagagaaatcagctcatggcttaggatggaattagagacaggtgagggacactcaggagctcattttccagctgctcttcagagtggaagggctggctggatcgggtaggtaagaatagctggattttttagaaaagaaatggatacagtctaaagaattaactcacccggtactttattctaagaagggtctggcatccatatgaggaaaaatgctcagctccaggaaagatggggagtccaagtggattaatgatgtcatgcataattttaagagacaagggagaaaacacaatgtatagccagagaaggagaagctcccatccaaatcctactaggaagagagtgggctgcagatgaatctgtgactcatgtttccctgtttcaaagggatcctggggaaggaggggaacatgcttgcagtatctctccctgtctgtctgctcacataagcattccgtccatctgagctcatcgtgctactggtatgtgtatgtgcagttacacagttttctgtatcatagattctagtgtgtttatacaaggagacatctgtggtttccccaaccgttccaaaaggctatttcaaaggaaccagccaacgtatgagaaatgaatgtaacactgtggacattgacttcccgcataaggcagggtgaccccctgaactccagatgtctgcacagtatcttatgtgttgttttccgttgtgacgaatgtgattggaacatttggggagcacccagagggatttctcagtgggaagcattacactttgctaaatcatgtatttattcctgattaaaacaaacctaataaatatttaacccttggca

SEQ ID NO: 29943 - DNA, 2102 bp, Homo sapiens
actgctacccacagggcccccactccacctgctcccagacgaggccaactcctggccaagcttaggggcacagcggaggcgctctgtttctgatttttctcgccttccttggagatgcctgtgcttggaagggaaggcagaacattgcatcttggaacaaatctgcttttgatcatgcaaatgaatgcctggataatgtaggcagactgtcaatttcaccagttagaaagaaagagaaaagggggagaaattccccatgacagcgactgatgaagaatttcaatagaaagctgctacttcagaaaataagatcatttgctgcgaatggagaacatctcaggcagccctgatgctccaccggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccccgatattccgccgaggggagaaactgcgtgtgatttctgatgaagggggctggtggaaagctatttctcttagcactggtcgagagagttacatccctggaatatgtgtggccagagtttaccatggctggctgtttgagggcctgggcagagacaaggccgaggagctgctgcagctgccagacacaaaggtcggctccttcatgatcagagagagtgagaccaagaaagggttttactcactgtcggtgagacacaggcaggtaaagcattaccgcattttccgtctgcccaacaactggtactacatttccccgaggctcaccttccagtgcctggaggacctggtgaaccactattctgaggtggctgatggcctgtgctgtgtgctcaccacgccctgcctgacacaaagcacggctgccccagcagtgagggcctccagctcacctgtcaccttgcgtcagaagactgtggactggaggagagtgtccagactgcaggaggaccccgagggaacagagaacccgcttggggtagacgagtcccttttcagctatggccttcgagagagcattgcctcttacctgtccctgaccagtgaggacaacacctcctttgatcgaaagaagaaaagcatctccctgatgtatggtggcagcaagagaaagagctcattcttctcatcaccaccttactttgaggactagccaagaacagacacaatggttcatgcccaaaaggaacagaagttccaactattgcctgggatcttgcgaaaagcgaggttccctgatccctgggagcctcacgtattttagaagccaagagaagccacatggagactcaaattcgcatcttctctatccacatcatgaccaaaggaacccctccctggtgtctgatcagggctgtggcatcacgaaacattggatcatgacatgtcgggcgatgcttggaagagcccagcatgtatgtatgcacacattgtgtgtgtgggaaggacaaagccactctcacaagaaagggcaccaggactgctctccaaggaactggacctgtccagacagttacactccaaggtcattggagagaacttctgtatgggcaagcctgagagggagaggaaacaaaagctgtgtcctggcagaaggtctgggtttgcagatgggtgccctgaatggaactactttaactaatccatagggacttctggtatgctttcctctctttttaaaggaacttcgtgacactaaacattagcccaaaggacttcttagccttcaattgggagatacctttggtctgctcctgcaccaaagccatatgggtggaagtcagttggcctccctggttctgcagagggccagaagaatgagagagaggaagactgctggcagggaaatcgaggaggcgagactagaactgcaccagcttccctgatgtctgcagccatggctttgcagcgcagacagagcttctctgggatgctgggattcttgcctgtatgaatgcatcaagtattcatttattgcccgaataggcattgcattaagtcctctgtaaggtgtcaggcaagcc

SEQ ID NO: 29944 - DNA, 1914 bp, Homo sapiens
aaccaatcttcaccaatctcatcttcacatataaacagccgcctttcaagaagcaagctgccagaaaaatgatgcacgatgctctctaaactgggtcattctccacttggagggctcagggcacggttgactttccccgtctgtctcctataccacaggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccccgatattccgccgaggggagaaactgcgtgtgatttctgatgaagggggctggtggaaagctatttctcttagcactggtcgagagagttacatccctggaatatgtgtggccagagtttaccatggctggctgtttgagggcctgggcagagacaaggccgaggagctgctgcagctgccagacacaaaggtcggctccttcatgatcagagagagtgagaccaagaaagggttttactcactgtcggtgagacacaggcaggtaaagcattaccgcattttccgtctgcccaacaactggtactacatttccccgaggctcaccttccagtgcctggaggacctggtgaaccactattctgaggtggctgatggcctgtgctgtgtgctcaccacgccctgcctgacacaaagcacggctgccccagcagtgagggcctccagctcacctgtcaccttgcgtcagaagactgtggactggaggagagtgtccagactgcaggaggaccccgagggaacagagaacccgcttggggtagacgagtcccttttcagctatggccttcgagagagcattgcctcttacctgtccctgaccagtgaggacaacacctcctttgatcgaaagaagaaaagcatctccctgatgtatggtggcagcaagagaaagagctcattcttctcatcaccaccttactttgaggactagccaagaacagacacaatggttcatgcccaaaaggaacagaagttccaactattgcctgggatcttgcgaaaagcgaggttccctgatccctgggagcctcacgtattttagaagccaagagaagccacatggagactcaaattcgcatcttctctatccacatcatgaccaaaggaacccctccctggtgtctgatcagggctgtggcatcacgaaacattggatcatgacatgtcgggcgatgcttggaagagcccagcatgtatgtatgcacacattgtgtgtgtgggaaggacaaagccactctcacaagaaagggcaccaggactgctctccaaggaactggacctgtccagacagttacactccaaggtcattggagagaacttctgtatgggcaagcctgagagggagaggaaacaaaagctgtgtcctggcagaaggtctgggtttgcagatgggtgccctgaatggaactactttaactaatccatagggacttctggtatgctttcctctctttttaaaggaacttcgtgacactaaacattagcccaaaggacttcttagccttcaattgggagatacctttggtctgctcctgcaccaaagccatatgggtggaagtcagttggcctccctggttctgcagagggccagaagaatgagagagaggaagactgctggcagggaaatcgaggaggcgagactagaactgcaccagcttccctgatgtctgcagccatggctttgcagcgcagacagagcttctctgggatgctgggattcttgcctgtatgaatgcatcaagtattcatttattgcccgaataggcattgcattaagtcctctgtaaggtgtcaggcaagccaaaaaaaaaaaaaa

SEQ ID NO: 29945 - DNA, 826 bp, Homo sapiens
attccccatgacagcgactgatgaagaatttcaatagaaagctgctacttcagaaaataagatcatttgctgcgaatggagaacatctcaggcagccctgatgctccaccgctggaggaggtcacgtgacattcacaggcatccagtcccagggtacctcctgctgcctggccccactgggtttatttgaatagtctgacttgatcaatccacagagccttctaacaattcaagtccttgcagagagaagcttgctcagagtggttactgaaaacaggaacctgcccttctgcaagccctgtgccttcctcgttcctagcagaggaagtatgcggccagtttagcaactgcagttcttctgtgtagcatgggctgcttctccacaaccgcgagaagcccggctgcctgtttattctggagcagcagcagttgacagacggagaggcagtgactctgcacccagcaatccctctgcagacagctcccacaggagtcatgcccagtgtgtgaaggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccccgatattccgccgaggggagaaactgcgtgtgatttctgatgaagggggctggtggaaagctatttctcttagcactggtcgagagagttacatccctggaatatgtgtggccagagtttaccatggctggctgtttgagggcctgggcagag

SEQ ID NO: 29946 - DNA, 563 bp, Homo sapiens
aagatcatttgctgcgaatggagaacatctcaggcagccctgatgctccaccgtccttgcagagagaagcttgctcagagtggttactgaaaacaggaacctgcccttctgcaagccctgtgccttcctcgttcctagcagaggaagtatgcggccagtttagcaactgcagttcttctgtgtagcatgggctgcttctccacaaccgcgagaagcccggctgcctgtttattctggagcagcagcagttgacagacggagaggcagtgactctgcacccagcaatccctctgcagacagctcccacaggagtcatgcccagtgtgtgaagcccggacacagcaccttctgtcacggagactgaactctgactggcaagacagaacgggtgggagtgcaagcaacagcagagaagactgttagcgtagaagaacccaggcctctaggactgactcaaactttctcatctcatgaccctgggctctgggcatcaccagcggccccagggaaaaagaaagaaatgggaaacagcatgaaatccacccctgcgcctgccgagaggc

SEQ ID NO: 29947 - DNA, 586 bp, Homo sapiens
aagatcatttgctgcgaatggagaacatctcaggcagccctgatgctccaccgtccttgcagagagaagcttgctcagagtggttactgaaaacaggaacctgcccttctgcaagccctgtgccttcctcgttcctagcagaggaagtatgcggccagtttagcaactgcagttcttctgtgtagcatgggctgcttctccacaaccgcgagaagcccggctgcctgtttattctggagcagcagcagttgacagacggagaggcagtgactctgcacccagcaatccctctgcagacagctcccacaggagtcatgcccagtgtgtgaagaacaggaaaccaaggtccaagttcacacaaaggaaataacattggtccaaagaccggagggaaaataaggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccccgatattccgccgaggggagaaact

SEQ ID NO: 29948 - DNA, 594 bp, Homo sapiens
gtcttcagagggacttgatggatcctgtacccaccctccgtctttggtctgaagaaaatgggtgggtctctgctggtggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccccgatattccgccgaggggagaaactgcgtgtgatttctgatgaagggggctggtggaaagctatttctcttagcactggtcgagagagttacatccctggaatatgtgtggccagagtttaccatggctggctgtttgagggcctgggcagagacaaggccgaggagctgctgcagctgccagacacaaaggtcggctccttcatgatcagagagagtgagaccaagaaagggttttactcactgtcggtgagacacaggcaggtaaagcattaccgcattttccgtctgcccaacaactggtactacatttccccgaggctcaccttccagtgcctggaggacctggtgaacca

SEQ ID NO: 29949 - DNA, 582 bp, Homo sapiens
aactttgctgtcattgggaccccctgggtgggccataggtggcctggggtggtatgtgggggagggtcttcagagggacttgatggatcctgtacccaccctccgtctttggtctgaagaaaatgggtgggtctctgctggtgtccttgcagagagaagcttgctcagagtggttactgaaaacaggaacctgcccttctgcaagccctgtgccttcctcgttcctagcagaggaagtatgcggccagtttagcaactgcagttcttctgtgtagcatgggctgcttctccacaaccgcgagaagcccggctgcctgtttattctggagcagcagcagttgacagacggagaggcagtgactctgcacccagcaatccctctgcagacagctcccacaggagtcatgcccagtgtgtgaaggctctgggcatcaccagcggccccagggaaaaagaaagaaatgggaaacagcatgaaatccacccctgcgcctgccgagaggcccctgcccaacccggagggactggatagcgacttccttgccgtgctaagtgactacccgtctcctgacatcagccccc

SEQ ID NO: 29950 - DNA, 2757 bp, Homo sapiens
gtgagaaccacagagtctgcagtcggagctagagctccaaggaccccacgcctgtgtctctgtgacagagctcaaagggccctgggccttccctccctggctcggctgtgcttgggagggttccccagtccagaatccctaaggagcatggggcagctgatccatccctggtgtacaaactgctgactgcagacagatgctgagctacccaaaccaacacctagcctctccctgaagatcctcccaggctgagagagttctgggtgtcctaggaccaaggacactggcagacttccagaagggcccccaaagccctaacctgtccagccagagcatgcgtctcagcagagctgtcttcccaagcctttgatgacaaaccaatttccctcgatgatgtgcttctgagtgctctgctgaggaacaatgggaagtctgcccagcagaagaaaatctctgccaagcccaagcttgagttcctctgtccaaggccagggacctgtgaccatggaagcagagagaagcaaggccacagccgtggccctgggcagtttcccggcaggtggcccggccgagctgtcgctgagactcggggagccattgaccatcgtctctgaggatggagactggtggacggtgctgtctgaagtctcaggcagagagtataacatccccagcgtccacgtggccaaagtctcccatgggtggctgtatgagggcctgagcagggagaaagcagaggaactgctgttgttacctgggaaccctggaggggccttcctcatccgggagagccagaccaggagaggctcttactctctgtcagtccgcctcagccgccctgcatcctgggaccggatcagacactacaggatccactgccttgacaatggctggctgtacatctcaccgcgcctcaccttcccctcactccaggccctggtggaccattactctgagctggcggatgacatctgctgcctactcaaggagccctgtgtcctgcagagggctggcccgctccctggcaaggatatacccctacctgtgactgtgcagaggacaccactcaactggaaagagctggacagctccctcctgttttctgaagctgccacaggggaggagtctcttctcagtgagggtctccgggagtccctcagcttctacatcagcctgaatgacgaggctgtctctttggatgatgcctaggcccaaaggagaggccaaaagggaaaccaaggctgcacacctagaaccccaattcagcctcctgggcaccccagaggcaaggctgtgcactcagggagggagggtgggacacagaggtgcatctagggtcccacctgtacccttgctctttcctctcttagcccttagaagtcacctacttccttccagtgccatgatcccacctgcgacctctagtgcgagtgcagagaaggtgggaccagggccagggttccaaaaagagaataagcctcctggggggtctgacctagttagttcttgagtttggggtttccagtaccatctggatgccctgcctgttgagccccattctacatccccaccattaaccaggccccacccacaaggtagaaacaacccctagagtcaacgagaaagtcattttcagaaaatctacaagtctcgttgagaccaccaccatacctcagaaggtaggactgtggcctagaagggaaaggaaagctgagatgatgtcttaccgtagcagcagatcttggatggtccaggctctatgtgacctccagagcaaagagaaagacttcggacagtctaggtcctcaaatgtcccccattgaggacaacagccccagctctttttcttttttttgagacggagtcttgccctgttgcccatgctggagtgcaatggcacgatctcagctcactgcaacctccatctcctggattcaaacaattctcctgcctcagcctccagaatagctgggattacaggcgtacaccaccatgcctggctaatttttttgtatttttagtagacatggggtttcaccacattggccaggctggtgtcgaactcctgacctcaggtgatccacccaccttggcctcccaaagtgctgggattacaggtgtgagccacggcacccagcctagctctcagatctctatttcattttgtggcttaccattccctagcacactggccttgccatcttgtggccgaataaaaaataacacctcttaagtctagcacactgcagtgaggccaggcacctcagtgctgggcaggggcatcagaaggtgctaagccctctctccacaatgccaagacggagaccacagcctacaccaaatccagcccttgatttccctgctgcctccataaacagaaagaggtctgctggatccgctaagggatcagggagaggaagaaagagggatggggtgggaggcaccccctccagtgctcctactggttcccaagctacaggtggggtgggaaaggctttatcaggtatcatcaacaggttctcaattaaagatttgatttattcaagtatgtgaaaacattctacaatggaaactcttattagatgctgcatgtactgtgctatggaccacgcacatacagccatgctgtttcagaagacttgaaatgccattgatagtttaaaaactctacacccgatggagaatcgaggaagacaatttaatgtttcatctgaatccagaggtgcatcaaattaaatgacagctccacttggcaaa

SEQ ID NO: 29951 - DNA, 2171 bp, Homo sapiens
tgcgtctcagcagagctgtcttcccaagcctttgatgacaaaccaatttccctcgatgatgtgcttctgagtgctctgctgaggaacaatgggaagtctgcccagcagaagaaaatctctgccaagcccaagcttgagttcctctgtccaaggccagggacctgtgaccatggaagcagagagaagcaaggccacagccgtggccctgggcagtttcccggcaggtggcccggccgagctgtcgctgagactcggggagccattgaccatcgtctctgaggatggagactggtggacggtgctgtctgaagtctcaggcagagagtataacatccccagcgtccacgtggccaaagtctcccatgggtggctgtatgagggcctgagcagggagaaagcagaggaactgctgttgttacctgggaaccctggaggggccttcctcatccgggagagccagaccaggagaggctcttactctctgtcagtccgcctcagccgccctgcatcctgggaccggatcagacactacaggatccactgccttgacaatggctggctgtacatctcaccgcgcctcaccttcccctcactccaggccctggtggaccattactctgagggctggcccgctccctggcaaggatatacccctacctgtgactgtgcagaggacaccactcaactggaaagagctggacagctccctcctgttttctgaagctgccacaggggaggagtctcttctcagtgagggtctccgggagtccctcagcttctacatcagcctgaatgacgaggctgtctctttggatgatgcctaggcccaaaggagaggccaaaagggaaaccaaggctgcacacctagaaccccaattcagcctcctgggcaccccagaggcaaggctgtgcactcagggagggagggtgggacacagaggtgcatctagggtcccacctgtacccttgctctttcctctcttagcccttagaagtcacctacttccttccagtgccatgatcccacctgcgacctctagtgcgagtgcagagaaggtgggaccagggccagggttccaaaaagagaataagcctcctggggggtctgacctagttagttcttgagtttggggtttccagtaccatctggatgccctgcctgttgagccccattctacatccccaccattaaccaggccccacccacaaggtagaaacaacccctagagtcaacgagaaagtcattttcagaaaatctacaagtctcgttgagaccaccaccatacctcagaaggtaggactgtggcctagaagggaaaggaaagctgagatgatgtcttaccgtagcagcagatcttggatggtccaggctctatgtgacctccagagcaaagagaaagacttcggacagtctaggtcctcaaatgtcccccattgaggacaacagccccagctctttttcttttttttgagacggagtcttgccctgttgcccatgctggagtgcaatggcacgatctcagctcactgcaacctccatctcctggattcaaacaattctcctgcctcagcctccagaatagctgggattacaggcgtacaccaccatgcctggctaatttttttgtatttttagtagacatggggtttcaccacattggccaggctggtgtcgaactcctgacctcaggtgatccacccaccttggcctcccaaagtgctgggattacaggtgtgagccacggcacccagcctagctctcagatctctatttcattttgtggcttaccattccctagcacactggccttgccatcttgtggccgaataaaaaataacacctcttaagtctagcacactgcagtgaggccaggcacctcagtgctgggcaggggcatcagaaggtgctaagccctctctccacaatgccaagacggagaccacagcctacaccaaatccagcccttgatttccctgctgcctccataaacagaaagaggtctgctggatccgctaagggatcagggagaggaagaaagagggatggggtgggaggcaccccctccagtgctcctactggttcccaagctacaggtggggtgggaaaggctttatcaggtatcatcaacaggttctcaattaaagatttgatttattcaagtatgtgaaaa

SEQ ID NO: 29952 - DNA, 4394 bp, Homo sapiens
acgctccgcccggcccggcccggcccggccgtccatacttccctccggtgtccaccagagggcgaacgggagacgcgaatgtggttcgactacgcatgcgcacgccgctgggcgcacgtgcggagggcggcggggcgggagggtaaaggtaggaggtgagaggtgaaggggcgggcacccggcggccaggagagagagggagggcgccacgcaccggactgcgggccgagagcgcgcacgccgcgctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggtatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacgtgctgagagacagctctgggatcaggagcttggaggagttgtgtctgcaagtgaccgacctgctgccaggccttaggaagctcaggaacctactccctgagcatggatgcctgctgctgtcccctgggaacttctggcagaatgactgggaacgcttccatgctgatcctgacatcattgggaccatccaccagcacgagcctaaaaccctgcagacttcagccacactcaaagacttgttatttggtgttcctgggaagtacagcggggtgagcctctacaccaggaagaggatggtctcctacaccatcaccctggtcttccagcactaccatgccaagttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggctgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacgtctgcgtgtgggacgcgcagaccggggattgcctaacgcgcattccgcgcccaggcaggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaacc

SEQ ID NO: 29953 - DNA, 2731 bp, Homo sapiens
agaggtgaaggggcgggcacccggcggccaggagagagagggagggcgccacgcaccggactgcgggccgagagcgcgcacgccgcgctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggtatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacgtgctgagagacagctctgggatcaggagcttggaggagttgtgtctgcaagtgaccgacctgctgccaggccttaggaagctcaggaacctactccctgagcatggatgcctgctgctgtcccctgggaacttctggcagaatgactgggaacgcttccatgctgatcctgacatcattgggaccatccaccagcacgagcctaaaaccctgcagacttcagccacactcaaagacttgttatttggtgttcctgggaagtacagcggggtgagcctctacaccaggaagaggatggtctcctacaccatcaccctggtcttccagcactaccatgccaagttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggctgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaaccatatcatcatctgtcaggc

SEQ ID NO: 29954 - DNA, 2878 bp, Homo sapiens
atgaccctgactgaaaggctgcgtgagaagatatctcgggccttctacaaccatgggctcctctgtgcatcctatcccatccccatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacgtctgcgtgtgggacgcgcagaccggggattgcctaacgcgcattccgcgcccagggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaacttttttaaaaaaccatatcatcatctgtcaggc

SEQ ID NO: 29955 - DNA, 2925 bp, Homo sapiens
ctgggaacgcttccatgctgatcctgacatcattgggaccatccaccagcacgagcctaaaaccctgcagacttcagccacactcaaagacttgttatttggtgttcctgggaagtacagcggggtgagcctctacaccaggaagaggatggtctcctacaccatcaccctggtcttccagcactaccatgccaagttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggctgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacgtctgcgtgtgggacgcgcagaccggggattgcctaacgcgcattccgcgcccaggcaggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaactttttt

SEQ ID NO: 29956 - DNA, 683 bp, Homo sapiens
gtgtccctgcaccggccggcccctggagctccgcgtccccaccagacctccgcgggcccctggtgtgacggggggagatgcgcggcgtcgcatcccctggcctagttgctccgggaagctgttgtagaacctgctttggtgctgtttgggttttccggagtgcgggggagagcaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggtatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacgtgctgagagacag

SEQ ID NO: 29957 - DNA, 3634 bp, Homo sapiens
cccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtgggttcctgggcagcctgcgtgcccgcctgatgcttctgcaccccagccccaactgcagccttcgggcggagagcctggtccacgtgcacttcaaggaggagattggtgtcgctgagctcatcccccttgtgaccacctacatcatcttgtttgcctacatctacttctccacgcggaagatcgacatggtcaagtccaagtgggggctggccctggctgccgtggtcacagtgctcagctcgctgctcatgtctgtgggactctgcacactcttcggcctgacgcccaccctcaatggcggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacgtctgcgtgtgggacgcgcagaccggggattgcctaacgcgcattccgcgcccagggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaactttttt

SEQ ID NO: 29958 - DNA, 550 bp, Homo sapiens
agagtccggtgggaactgggttttaggaggaggtatctgaagaatgtgtagtgggtcgggggctggtgcggtcagaagggccacctctaatttctgccttgcattggtgactagatctgcactttctggaactcccagagaagtttgctggtgcctttgagggcaggtacagggcctgccttatccaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtgggtgggtactcgt

SEQ ID NO: 29959 - DNA, 706 bp, Homo sapiens
agagagagagagagagagagagagagtgtgtgtgtgtgtgtgtgtgtgtgtgtgtgtgtgtgtgtgtgtattttgggattgaggtcactagaccttgcatataggcattctgaaaccattccccagccacataactatcgcctccctccagcagccctagtgtgcagagccaagtactctttgttaactggcttttctcccttcttaccaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggtatgtgggtgccccggtggcttatgtccagcagatatttgtgaagtcctcagtgtttccctggcacaagaacctcctggcagtagatgtatttcgttcacctttgtcccgggcattccaactggtggaggagatccggaaccacg

SEQ ID NO: 29960 - DNA, 3422 bp, Homo sapiens
acccggcggccaggagagagagggagggcgccacgcaccggactgcgggccgagagcgcgcacgccgcgctccgcccctgctgccgcccccgtcgccgccgccgccgccgccgcagcttgggaggtgctgccaccacaggtacctgcacatgttgttctttgtcagtgctgtcaagtgtgtgccagggtgatccatggtcactttccgggatggcagcaaggtgacttcggctgaggatgaccctgactgaaaggctgcgtgagaagatatctcgggccttctacaaccatgggctcctctgtgcatcctatcccatccccatcatcctcttcacagggttctgcatcttagcctgctgctacccactgctgaaactccccttgccaggaacaggacctgtggaattcaccacccctgtgaaggattactcgcccccacctgtggactctgaccgcaaacaaggagagcctactgagcagcctgagtggcgagattttcccctaccttgtggtggttattgggttagagaatgtgttggtgctcaccaagtctgtggtctcaaccccggtagacctggaggtgaagctgcggatcgcccaaggcctaagcagcgagagctggtccatcatgaagaacatggccacggagctgggcatcatcctcatcggctacttcaccctagtgcccgccatccaggagttctgtctctttgctgtcgtggggctggtgtctgacttcttccttcagatgctgtttttcaccactgtcctgtccattgacattcgccggatggagctagcagacctgaacaagcgactgccccctgaggcctgcctgccctcagccaagccagtgggacagccaacgcgctacgagcggcagctggctgtgaggccgtccacaccccacaccatcacgttgcagccgtcttccttccgaaacctgcggctccccaagaggctgcgtgttgtctacttcctggcccgcacccgcctggcacagcgcctcatcatggctggcaccgttgtctggattggcatcctggtatacacagacccagcagggctgcgcaactacctcgctgcccaggtgacggaacagagcccattgggtgagggagccctggctcccatgcccgtgcctagtggcatgctgccccccagccacccggaccctgccttctccatcttcccacctgatgcccctaagctacctgagaaccagacgtcgccaggcgagtcacctgagcgtggaggtccagcagaggttgtccatgacagcccagtcccagaggtaacctgggggcctgaggatgaggaactttggaggaaattgtccttccgccactggccgacgctcttcagctattacaacatcacactggccaagaggtacatcagcctgctgcccgtcatcccagtcacgctccgcctgaacccgagggaggctctggagggccggcaccctcaggacggccgcagtgcctggcccccaccggggcccatacctgctgggcactgggaagcaggacccaagggcccaggtggggtgcaggcccatggagacgtcacgctgtacaaggtggcggcgctgggcctggccaccggcatcgtcttggtgctgctgctgctctgcctctaccgcgtgctatgcccgcgcaactacgggcagctgggtggtgggcccgggcggcggaggcgcggggagctgccctgcgacgactacggctatgcgccacccgagacggagatcgtgccgcttgtgctgcgcggccacctcatggacatcgagtgcctggccagcgacggcatgctgctggtgagctgctgcctggcaggccacgtctgcgtgtgggacgcgcagaccggggattgcctaacgcgcattccgcgcccagggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgtgggacgccattgaaggggtgctgtgctgcagcagcgaggaggtctcctcaggcattaccgctctggtgttcttggacaaaaggattgtggctgcacggctcaacggttcccttgatttcttctccttggagacccacactgccctcagccccctgcagtttagagggaccccagggcggggcagttcccctgcctctccagtgtacagcagcagcgacacagtggcctgtcacctgacccacacagtgccctgtgcacaccaaaaacccatcacagccctgaaagccgctgctgggcgcttggtgactgggagccaagaccacacactgagagtgttccgtctggaggactcgtgctgcctcttcacccttcagggccactcaggggccatcacgaccgtgtacattgaccagaccatggtgctggccagtggaggacaagatggggccatctgcctgtgggatgtactgactggcagccgggtcagccatgtgtttgctcaccgtggggatgtcacctcccttacctgtaccacctcctgtgtcatcagcagtggcctggatgacctcatcagcatctgggaccgcagcacaggcatcaagttctactccattcagcaggacctgggctgtggtgcaagcttgggtgtcatctcagacaacctgctggtgactggcggccagggctgtgtctccttttgggacctaaactacggggacctgttacagacagtctacctggggaagaacagtgaggcccagcctgcccgccagatcctggtgctggacaacgctgccattgtctgcaactttggcagtgagctcagcctggtgtatgtgccctctgtgctggagaagctggactgagcgcagggcctccttgcccaggcaggaggctggggtgctgtgtgggggccaatgcactgaacctggacttgggggaaagagccgagtatcttccagccgctgcctcctgactgtaataatattaaactttttt

SEQ ID NO: 29961 - DNA, 1295 bp, Homo sapiens
gacgtcagagaccaatggctgcggccgcagctgcggcgctggaatcctggcaggcggcggctccgcggaagaggcgctccgcggctcgacggccgcggcggagggaggcggcgccccgggggagagaggcggcgccccgggggagagaggcggcgccccggggccccgaggcggagttcgagtctgacagcggagtcgtgcttcgtcgcatctgggaggctgagaaggacctgtttatctctgatttctggagttcagcactagaaaccatcaatagatgtctcacaaaacatctggaacaactgaaggcccctgtggggactctttcagacatctttggaaacctgcatcttgactcattgccagaggagtcagatgtggccactgattctatcccaagagagatcttggtcacaggaacctgccatttgaagtgtgtgtgttacggcattgggaactttgccacctgcatcgtagctagaaaccagctaacgtttttgctgcttttgttggaaaagtgccagattcccagaagtcactgttgggtatatgaccctctgtttagccaacttgaaattgaagtccttaacacccttggtgtgactgttctcagtgagaacgaggaagggaaacggagtattcgcggggagcctaccatcttttacatgctccattgtgggacggccttgtacaacaatcttttatggagtaactggtcagtagatgccctttctaagatggtcatcattgggaacagtttcaaaggacttgaggagaggttgttggcaaggattctgcagaaaaattatccctacattgcaaagattttaaaaggactggaggagcttgagtttcctcagacttcacaatacatggacatatttaatgatacctctgtccactggttccctgtgcaaaagctagaacagctctccatagatatttgggagtttcgggaagaaccagattatcaggactgtgaggaccttgaaatcatcaggaacaagagagaagatccttctgctactgactgaactcgttgtgaggtactcagtgttggctgaggtagaagctgccaccagagactaaagggaaggctgctatggaggaactacagagaactcctttgccaggaaagaacatcaacttggctgtcctgttttgaggacgataccccacatgaggacttggtataaagattcctgccctacgtggcattgtcccattttacatccttccctcatgacctggcctgatgtggagtagctcctgagtaaagaagttacccttttgaa

SEQ ID NO: 29962 - DNA, 4108 bp, Homo sapiens
ccggccgtctatgctccaggccctctcctcgcggtgccggtgaacccgccagccgccccgatgtacagcatgatgatggagaccgacctgcactcgcccggcggcgcccaggcccccacgaacctctcgggccccgccggggcgggcggcggcgggggcggaggcgggggcggcggcggcggcgggggcgccaaggccaaccaggaccgggtcaaacggcccatgaacgccttcatggtgtggtcccgcgggcagcggcgcaagatggcccaggagaaccccaagatgcacaactcggagatcagcaagcgcctgggggccgagtggaaggtcatgtccgaggccgagaagcggccgttcatcgacgaggccaagcggctgcgcgcgctgcacatgaaggagcacccggattacaagtaccggccgcgccgcaagaccaagacgctgctcaagaaggacaagtactcgctggccggcgggctcctggcggccggcgcgggtggcggcggcgcggctgtggccatgggcgtgggcgtgggcgtgggcgcggcggccgtgggccagcgcctggagagcccaggcggcgcggcgggcggcggctacgcgcacgtcaacggctgggccaacggcgcctaccccggctcggtggcggcggcggcggcggccgcggccatgatgcaggaggcgcagctggcctacgggcagcacccgggcgcgggcggcgcgcacccgcacgcgcaccccgcgcacccgcacccgcaccacccgcacgcgcacccgcacaacccgcagcccatgcaccgctacgacatgggcgcgctgcagtacagccccatctccaactcgcagggctacatgagcgcgtcgccctcgggctacggcggcctcccctacggcgccgcggccgccgccgccgccgctgcgggcggcgcgcaccagaactcggccgtggcggcggcggcggcggcggcggccgcgtcgtcgggcgccctgggcgcgctgggctctctggtgaagtcggagcccagcggcagcccgcccgccccagcgcactcgcgggcgccgtgccccggggacctgcgcgagatgatcagcatgtacttgcccgccggcgaggggggcgacccggcggcggcagcagcggccgcggcgcagagccggctgcactcgctgccgcagcactaccagggcgcgggcgcgggcgtgaacggcacggtgcccctgacgcacatctagcgccttcgggacgccggggactctgcggcggcgacccacgagctcgcggcccgcgcccggctcccgccccgccccggcgcggcgtggcttttgtacagacgttcccacattcttgtcaaaaggaaaatactggagacgaacgccgggtgacgcgtgtcccccactcaccttccccggagaccctggcgaccgccgggcgctgacaccagacttgggttttagactgaacttcggtgttttcttgagactttttgtacagtatttatcacctacggaggaagcggaaagcgttttctttgctcgaggggacaaaaaagtcaaaacgaggcgagaggcgaagcccacttttgtataccggccggcgcgctcactttcctccgcgttgcttccggacggcgccgaccgccggagcccaagtgacgcggagctcgtcgcatttgttataaatgtagtaaggcaggtccaagcacttacaagttttttgtagttgttaccgctcttttgggttggtttgttaatttatacaaagagattaccaccaccaccccctccttcagacggcggagttatattctgggttttgtaaaactttatgtatctgagcatttccatttttttttttgggttttgtattatttcttgtaaatgcattgtgaaaaattttattttcggcgttgcaatgcggggaggagaagtcagattatgtacatagttttctaaaaagcctttcttctaaaaacgaaaaaagaccccccacccaaaatgtttcgagtcaacaaatttaagagacagagcccattttctccataaatttgtaacatgctatttttatgtgcatgttttatgagttcaaaatgcaatgaggaaatctgacagggaaattatctgtatgaactaaaagtaagggaaccccggggaatgggaggacaggatttttcaaggaacctttttcaatgaaagagaaggaagttaaaacctataggttattttgtagagctgagtgttaatacgggccgagaaataaaagtatcttctgctccggctgtttcactgcggacggctggggctgctgcgcgttaccttgctgcaagcggggcgccttccacctggctgggggtctgcgccacagtttggtccagaggagggaggaggaagggaagaccccagtggtgggaccctggaccaggccatggatgaaggacaaagaccagggcaggtcacgggtttcccaattccccagcaattaagatttcgagcagaatttatctaaatgtgtttcaaggaaacacaatcgctgaaccaaaacgtactgcagccgagccccctccgtccatcctctgcccctccccctggcttctttctcttgggaaaacgggcaaaataattgtgctggattctcacacacacagaaatatcgaccatcaccctcccccgcgtgaactgggatgcaagttgctaaccgatgtgaacgcaaaatgccttgttcattattcctgacgagatcttgaggttgtttgatgctttaaattttttaattatattattttctaggtgtttattggtacattgcagttttttttttgaaatttaaaaatttctgtaaaactttgtcttcaagtaatctgacagcattaaatattgcatttaaaaattatactgtagcaaatacatttaaaaattaatcacaacgttaagatgaaattatatttttggaaaaaaaaaacacttgaagcccagatggaaatacgtttatttcagcagccttaggtttcccctcgctttctcaacacccttccttgtcctggagtatggactgtccgtccaaaagtgagcctatgctataagtttaatgagaaccgaattcagcctgcattcgagaatagctttaagtataatgctgatctgacaattgacgtgtaatttgggaagtcattttgataattttgcttaaaccactcattcgttaaagtgattacaaaaaagttcaagaatgatgtccactgctttctaacaagataataaaccccccccctcttttctttttctttatttttatttcttttagctatttgatcctttctgaagcagttgtttctggaagagtctgtgcgcccatggatggctgagcaccactacgacttagtccgggataagggcctccccagtcctctccgggagatgatttgggaaattttataatgcttgttctgttaactcaccgggaccttgagggtccaatgggaccttgagggttttctctgaaatatacaaacttaaaggactctctctgaggttctttgactgacgtccactctcagtctggcccctgtgctcccctgtgtgtaccctggagtttctgtgtccaattgttggcatctaggtcttggctcaagattaggatgtgggccccactttagaggcacagactatgaaaagctgagttagtgcgcccgggacgccaggcaagcagcttttacagtttggcatcttattgcaggtgcttcgtgcacagtcagctgaaatagccaatgccaggtgctccaaccaccttatttccttgttttgttgattagaacaacacagaaaaaagcaaatataaatttttaatgactccatttaaaaatatcacagggtgggggcaaggaaattagctgagattcatctcaggattgagattctatccccccttccccgcccccagcagtgtcgctccaattcaaattagtggagaaaagattacagtaggccctgagccgactgtgaattcggtgcttggccaaggtaacactcatcgtattcacggagtgaaatactatatgatgatagttattatattatatgacgacttcattcacttcccaaatcacagggt

SEQ ID NO: 29963 - DNA, 8718 bp, Homo sapiens
acctccgcacgagacccagcggcccgggttggagcgtccagccctgcagcggatcatggtgcagcaggcggagagcttggaagcggagagcaacctgccccgggaggcgctggacacggaggagggcgaattcatggcttgcagcccggtggccctggacgagagcgacccagactggtgcaagacggcgtcgggccacatcaagcggccgatgaacgcgttcatggtatggtccaagatcgaacgcaggaagatcatggagcagtctccggacatgcacaacgccgagatctccaagaggctgggcaagcgctggaaaatgctgaaggacagcgagaagatcccgttcatccgggaggcggagcggctgcggctcaagcacatggccgactaccccgactacaagtaccggccccggaaaaagcccaaaatggacccctcggccaagcccagcgccagccagagcccagagaagagcgcggccggcggcggcggcgggagcgcgggcggaggcgcgggcggtgccaagacctccaagggctccagcaagaaatgcggcaagctcaaggcccccgcggccgcgggcgccaaggcgggcgcgggcaaggcggcccagtccggggactacgggggcgcgggcgacgactacgtgctgggcagcctgcgcgtgagcggctcgggcggcggcggcgcgggcaagacggtcaagtgcgtgtttctggatgaggacgacgacgacgacgacgacgacgacgagctgcagctgcagatcaaacaggagccggacgaggaggacgaggaaccaccgcaccagcagctcctgcagccgccggggcagcagccgtcgcagctgctgagacgctacaacgtcgccaaagtgcccgccagccctacgctgagcagctcggcggagtcccccgagggagcgagcctctacgacgaggtgcgggccggcgcgacctcgggcgccgggggcggcagccgcctctactacagcttcaagaacatcaccaagcagcacccgccgccgctcgcgcagcccgcgctgtcgcccgcgtcctcgcgctcggtgtccacctcctcgtccagcagcagcggcagcagcagcggcagcagcggcgaggacgccgacgacctgatgttcgacctgagcttgaatttctctcaaagcgcgcacagcgccagcgagcagcagctggggggcggcgcggcggccgggaacctgtccctgtcgctggtggataaggatttggattcgttcagcgagggcagcctgggctcccacttcgagttccccgactactgcacgccggagctgagcgagatgatcgcgggggactggctggaggcgaacttctccgacctggtgttcacatattgaaaggcgcccgctgctcgctctttctctcggagggtgcagagctgggttccttgggaggaagttgtagtggtgatgatgatgatgataatgatgatgatgatggtggtgttgatggtggcggtggtagggtggaggggagagaagaagatgctgatgatattgataagatgtcgtgacgcaaagaaattggaaaacatgatgaaaattttggtggagttaaagtgaaatgagtagtttttaaacatttttcctgtcctttttttgtcccccctcccttcctttatcgtgtctcaaggtagttgcatacctagtctggagttgtgattattttcccaaaaaatgtgtttttgtaattactatttctttttcctgaaattcgtgattgcaacaaaggcagagggggcggggcgggggaggggaggtaggacccgctccggaaggcgctgtttgaagcttgtcggtctttgaagtctggaagacgtctgcagaggacccttttggcagcacaactgttactctagggagttggtggagatatttttttttcttaagagaacttaaagaactggtgatttttttttaacaaaaaaagggaccattgcaacttttgttaatttaattttttttttttttttttttttttttttttttggagggagaaaactgatgtcttctatgcatccgattcttaacaaaactgcagggagcttgaaaaaatgcagactgtacaaacgcttacaaaaaaaaaaactgtgaactgacttaagatcagagtttacttttcagatcaaattgtttatggttttacaaatgtgatttctacttgccaactttttttttgtaacttgttcccttatacctccttgattgaataccagacagcctagacctcagtacaaaaggtattgaaacatttttgatacataacagacctcagtcttttttaaaaattaatatattttcaggcgtatttttgtacagtgaaaagggaacattcttgctgtgttttttcagtaagactttcaggcacttcttcccttttgatttcttttttttcctctgttttttagcatgcaagtatgttggtacgttatgtcctggtttaaaaaggattaaaattttaaaataatccttgcatctaaaggccttgtggtttaaaaaaaaaaagcaaacttttttttgtacagctatagtagagatttgttcaatatttgtaggtaaagatttattgaaaatggtgatatagacctcagagctgttatcttagtttaaagattgtatatgtactgtactatagtaggactttatgtatctcatacgctgtgatgtggatggggccccagatggaaggtttgaaactggattctcgatttttagcaaaaaagaaaaaaaaaaggcacatagtttaaaaagtttctcattttgtgcaatataatctaaataaagtacagaccatctgcatattttgtagcaaatggtggcaaagcagactcaatgcactgtcgacatcattgcctgtttttttttttttttttttgtgctggaagtctgtatcttgacaattttaataaatcagctggaactgatagaaactcgcatcgccaatagtctctatggaagtcaaactggaggtcctgttgtcgcagagcattcggtggtgaggctgttgtgtgcgcggatgaggggaggtggcaggagagaattctacatttagggggttaggctgaaaagtgttcaattagcaggctgatttctttttcctcttccgctagttgtgaaagacaggggaagggtgttctttctctctgccctccctttccatctccagctccccatttcctttctcacctcctcctccactccctgcctcttctccccacccatcctggcgggcgggctgcgcggaggctcgggagctggccggggaggggcggatggaggggcctgggttgccagctcccttggtcggggtcctgctcgctggggcttgtgtgttctctgcggcgggccgcgtccccgctgagcctcgcggtgacagccgcctttggcagcgagcgctcggggcacttctatccccgcctctcaaagggtggggacagccgtttccagatttgaattttttctgttctttatttttaacgctgcatcttcgcgtgtgctcagaggtggttgttggcggagaacgccgccgcagtgtttgacctctagcggtgaagggggaaggggaagaggaaaggagagaagtggtcggtgtctgtttccttctgtcccccggggccgtggagctgtcggagggaaggaggacggtgcggggccgcagggggcgcggggcgcggcgggacccaggctacgagcgggagggaggcgggagtcgggggaagacgcggcaggccggccgagggcaccccgaggaacatggcatggcctctgtgcgatccgagtcgcggtctccggggtgcctgggagggccgaaccactggtgagggcgtggggagcagggggtggcagagggcacccgggcggtagtccgggacgcgcaaggcagagccctgacgctccgggtccccgtgcctggctcttcttgcctcgccaccgcgtgctcctgggcgcgccccgccgcgggcccttgaggcgcgcggagacaccagcgctggcttcccgggcccgcgggccggggagggaagcctcggggctgcggggtgagaggaagaaagcaaacccggggagcaggcggctgccgcacccgcgcaccccgggccctcaccacgccctccccgcgcgccggctcaggggctgccccggaatcagctccccggggccgccgcaacgaaggtggatccgcatcttgattgttctccgggagcctcctgggggctccggcggcggcgcgggcgcgacccatcccgctggcgctccccgctcgctgaaccccgtttgcctgtccacaccccctcgctccccaccatttttcctgaccggcctgtgtccccgagccctcgcggcaggcccgagcaggcgatcgcggccgggcacgcgcgccccgggctcccgccccccttccgagcatccgccgcctcttttctgctgggtctgggaggagggaggctgggaggccgctcggggcccagcgtgccagccccggagttcagcctcccgagctgcggcgcccgcagcggaggaggttttcagtggctgattgaaactcactgcaaaatcaccacgactctttcacctactgagatgattgaccgaggtttggccttccatttttactgagatttggcgagaccgaatggaagcgtccgcacagtaactgcagctgctaggccagaggggccccggcgcccttcccgcctcccctcccgcttgcttttgccttactcgatcttaccaccacccctcccccggccccccgactgagaactcgggcctctcacccgccccccagcctcccgctctgggcgagcctcctccccagcccccacccctgggatgcgaagccagcaagcttttgctgcagatggacaggtttcttttctgtggctttttcctttcgataaaccatcagatttcagtagtacatttgggaaaagaaggggctgatggcgttaaccaggttctcaatatagaactggatttctggagttgtttaccttaccccacaccccctcaacatgtagactaatgcagccattggtggtacatttattttagccacggataattgaaccagcggtttacaattgacacgtgctccgtgctggtgattttatgtggcagccctctgctgcagttccgaaacttgttggcaacgtaaacccattgataggctgatctatgtattttgaaagcctgaaaacttggcatgtcttttctgttttaatcatagatgaatcttggacattttctgtggtgaggtggaaactttaagtaaattagtaaagtaataatttggcttcagaatgggaagagatagtcaagattttttttttttaaagccatgtggcctaacttgatacaaaaataaaagtaattgtttggcaatctaaatttaaaacctgttagaactcaggacaggcgcttcaatgcgctttttaacaatatttaaggctgttttgatgagtgcgttgtgagaatcatcttaatgaattctttattgagtgtctaaaacatagtataatacacatggtattcttgccactggatagtcttcaataaaagtttaattgatttttttttgttggtctcttaagtaagtcttatttttaactaagcattgacagaatatcttaaaatggtaacctgggggtggcgggtgggtgctgtgtgcacggcagcctagccagtggggatcctgctgtttattataagtagttcacagactctgatggcattttggtaagctttccatctttaagaaattgaaccagcattctcttattaattctttaaactgtggaagtaatttccagttcttacactctgatacgcatcccttttatttaaaaaaaaaaaaaatgctaataaaaggcagtgtacttaaactgtgctttgcaaatattgtgtatgttatgaatgactacagacactgggcaaattatttgtagaatgattatcctttagctagagaaagaaatcattacaactcttttgggcagagatgtttctttttaatgttaatcaaggggaagtgatttaaatatgcataaatgtagcagtcagggtgatttagttgcttttttcatgaaagaaaaagactcaaaagacaagacttatttttctcttctgggacttgaaatcataatcatctgatattagtacagtacaagaaatttacatttgttttttacttcagaatttaagtgacttttgcccaaggaatttgagaaataaggcaaataagttgctctattttaaagtagtcattcaatataaatatattatatcaatcttaacttttttattctctgatatgattaataatatgtatattcttacttttcttctaatgggcatatgtatccttgtggacactttgagagaggttttcttggactctcccatttatagaatctttatactcttttactgtgtggttccctgcttttaacagatttctgaggcaaatatatttgtgcttttttcttatgtaggaagaccagcgaaaatagtttactgagttgtcaattttatcagtagataagaaactttctttattacagtttcagggaagattttttcaggatatttctcagttattctaagggccaaattttgtaaaatttccattaggaatgtcagtttcaaataccctttgtatagcctaagcctgtgaggataacaagaatgagccttacctatcctaacacagggatttacaagttcccaaagtaaccgtctccatgtaactcttgacatacttttctgagatttggcttatttttattattggttatttctcactgttcattctatttgatttattctacaacatccccttttatttaatgatctggaaaattctgctctttgataacaactcaggatttttttgttcagttttggtttttgccccttcctgtggagcctacattttcaaccacaataaagatgaaacaaaatttatgaaactgagctctcttccattttacttactgctggcttttttttttttttttttccttgattcctaccataccttcgtttttttcattgtacttttttaacactacctatatccattagctgcctaattagttttatctgttccatgtggatgcagtgagtttataagagaatttcacaaacaagtagttttttagtgaacttaaaataaacagaattttaaaggagacctatttttatactcaataaaagcacaaaagtgcagaaagtataaaacggcttacaaagggagacacaagctcataatgttccatgtataaaagtaataactttattgggtagagatattcttacaagatctagcacctctgccagtgcacagataggactgttttaaatgatttgggaacttttggttgcctgcagttgtgaacagagaacttctctacagagaaacaaaccactaaaagcaatatgaccgagttgagatgtggtttccaatgagcaattggtgaatttaagcaacctggatgtgcatatgtggaggctcccgtctcactgtttgatcaaacttcttttatgtagtcacgtagacttgattttttctgctgtgaaaatgaaaaaataaagcaatatgacaaaaagtttaaaaatgcataaaaaataggatttcctctaggctcctcgaagagatttttttaatatgatgcttgtcttactttcttagacacgttacatttccccttccaaaaaaaaaaaaaaggacaactggaagtaatttatcatataaagaattttgatcaaatagatattgacaaagggccctctgtcacatttttcttcatccagcttttgttcaaaaacagtatgcctcctcccttgaatcacatagggagaaacgttatactccattctcattaatttcccattttgtctacttttactcttgtacatatgttgtgggtttaagagtcttttgcatttgttctgtgacacctttttttgaattgactgttttaaaacggaggcctattttttccggtttgggactcctagtggttatggcatcccataatgcttcgtgacggccaccaggacagaaccacctgatgttttagagcagttttcagcatgacactgttaacaagtgtgtattttccaaggccacatgaaacttactttcttagccactccaggtttgggagcagaaaagctgaaaaacccttttgtgtagaagtctgagtggtttgtgggggggaccttttttagagtttgcatgccagcgcacggcctattgctgtgaaacagagagaaggtaaagctacctgaggcagtgcgctggaggatgaagtgtttgatagcactaggggggaaagaaaatgcatggcaaagtttcgtcttctcgtagactatctagcatgcagagtgtagtgtgttgaaacggtgtatgacattgctgtatcaaagttgtaaaattaagcattatttattgaaaactatgtatttttttgtaaaaacctgatcacatagagaatatcagtggcttgtgcttgtgcttcgatctaaccagcttcttgacccacccccccttggtatgcagtgttaatgctcagggttgaaaatagtacactccaatgtctcttttgcaagagtttttcacagaggattacatttgttcaaaagactctaataaaattgtgtgatcaatcttc

SEQ ID NO: 29964 - DNA, 4627 bp, Homo sapiens
ccgcggcggagccagaggctgcaggaagagcccgcgggggcccggagggtgcgattcctcggcccccgcaaaacaatgtgtgttgtgagccaggacgcaacttgccggaggcggcgggggcgcgccgagcccgcctgagaccgcgctgaccttctccccccgccgtccgttgggcccgagcgcccagctcctcgctccccagttcgcgggggccgggccgagccgcggggcggggccgcccctccgtcgccgctgcctcctcccccacccccagccgcggaggatgcggacggcccccggcggcgtctagcggccccgggcccaggcgcgatggtgcagcagcggggcgcgagggccaagcgggacggcgggccgccgcccccgggacccgggccggccgaggagggggcgcgcgagcccggctggtgcaagaccccgagcggccacatcaagaggccgatgaacgcattcatggtgtggtcgcagcacgaacggcggaagatcatggaccagtggcccgacatgcacaacgccgagatctccaagcgcctgggccgccgctggcagctgctgcaggactcggagaagatcccgttcgtgcgggaggcggagcggctgcggctcaagcacatggcggattacccggactacaagtaccggccgcgcaaaaagagcaagggggcgcccgccaaggcgcggccccgcccccccggtggtagcggtggcggcagccggctcaagcccgggccgcagctgcctggccgcgggggccgccgagcagcgggagggcctttggggggcggggcggcggcgcccgaggacgacgatgaagacgacgacgaggagctgctggaagtgcgcctggtcgagaccccggggcgggagctgtggaggatggtcccggcgggacgggccgctcggggacaagcggagcgcgcccaagggccgtcgggcgagggggcggccgccgccgccgccgcctccccgacaccgtcggaggacgaggagccggaggaagaggaggaggaggcggcagcggctgaggaaggtgaagaggagacggtggcgtcgggggaggagtcgctgggctttctgtccaggctgccccctggcccggccggcctggactgcagcgccctggatcgcgacccggacctgcagcctccctcgggcacgtcgcacttcgagttcccggactactgcacccccgaggttaccgagatgatcgcgggggactggcgcccgtctagcatcgcagacctggttttcacctactgagcccaccgtcagcggggcgcgcacgcccccaaaccagctgtttacatacaggaatcaggtattggggcccctcggaggccgaggctggcaccccatctcccgcgcagcctgccccctcctggacgtgcccatcccccctcagatccagacatgcccctcccccgcagacacaccccaaggcagcccaacccccaccccttccccgacacccaagcccctccccacgtcgccccctcctgcacagccaccagcagccagccccctccgatacacctcccgtcctctcctacagacctgcacccctccccccttttgcacacgcccctcctcgtggccggaggacccgccccctcctttgctccggaatctctcctccctcgcccggcccgccttctctgggttaggggggcgatgcggccgggtggcaacgcacgcgcctcctgcgcccctcccttccctggggggaggggcgcaccccttttatccccggagcgctagggcccgcccctccgctggggcccacccccttcgtgcgcatgcttaatgcttctggggaggagggggctggtcccagcggagccgcactcttcgcccgctccgggcaaaagcgggggcgagtgtagagcgatcctgggaaatcctttgatccgggagccctaggtttcctctccagccaacggggcgtcgctgccttaatgggaggagcactcggaagggttggtttgggcctgaaactctcccaagtggcatagccccttttccggtatggggtctcctacacccacgcgcaccacctctccggtcgcgtggctgcctctacagcctacctatacgtccctttttccccccaactgggaattgagaggtaaggtctttctctggaaatccagcagtagaggaagggaccacccaagaaaactaaaaaccaaggcaccttaccagtctgtctggggacaggatccctgctgcaccttccccaccccctcctgggaagtgccccctcacctcagggcacccgcaacctgggctcctccctgagcgcaccggcccttcctgtcacccaggtccaccctcagtactcaagctgcagtatacagcgggaaaaactgaggcactttggtgctaggggtttgggactgaggcgtggagagcagatgtgatggcaggaagactctcgcttttaaacatctggtttgggagagaccatcgacttggccagtgagactgagaatggattccgagtagtgatgggccgtttgcacctcggtttttccacgtgagaaatggggagaacgctgctgttaggaggaagttgtgtccagttcagggtgccctcgggagccctgtccctgttgctgtggcccctctcacgccgccatctctctgccccgccccgcccctccggcctccccacaccccccttgccctcactacctgtatctcaccggcgtgtgttcaccctcccgggtggctcacacactctcattcacacacacaaatctcaggaacaaacggtcccagagtcctccggacccctgcccagggtctctgcaggtctctgccccacgcgttcccgtcgctgacaaagccaccagctgcctcctttaagcttggtgctccggctctgggcctttcttgcgctctattttttttttttttttttttaagaaaaacaacaacaacaaaaaaagacaatgaaaaaaaaaacgtcatgtgagtgaagagatgtcactgtctgtggtcttggagaactagtctcgtagctgaggggtggggtccctctgtctggggcactggcacccacagcaggactccgccagtctgatgccaggactgaataaagtgtatttgccccgaccttgccctgtggttctgcatgtctgtgctcttcctcaaccctccctaaacagtttgccagattcaagtccgtgtgatttgggcccgagctgggtgtcccagggcaagccaccttgcctgtctaggcctctatgtcaggactccctggccttcatgaagaatagcaaactcatccctgtagggaccaggcaggtaacatagacgagtgactctgggtggacagtggtgtcatgacccacttcaaggggcctacctcctgccagttgtgaccctgtgggaatgcagtccacagtggccaggtggccagatttttcaagaaaagctggatggatgtttctgagtcatcttaatttcaaaatgagactcatattttaaaatttctgtgggccaaatgaaacaagtatgcaggcaggtctggtccgagggggctggcttggccatgcctttctgtgcctttaatgaggactaagaagcaagattgggccacactgtctggactcaaagcccagctccaccactgagcacccgtgtgactctttccatatgtataacgtggggataataataatagctgcttcacaggatgaaatgaagtttgaggtgagaagcattcaccatggtgcccatcgtgttactccattgtcagaggaggaaacggggtcaggcaggaaagcaacttaaaggagggcctgcaagcagccagggtcagagacagggcttggttctgcttcctggtgaagcatggcttcggggtgctgcctctccctccctgtttgaatctgcagattgtgttaggcccccagctgagggcctggagtggtgggattggtcccagtgcctggcgcacattggcctgcagagtagattaactgaatgaccaaagagcaacagaagtctagtgattcttgtctttgaggttctgactggtgttttacaactgagtccaaggcttttccctcctttgtccctctgacacccctccccctaattctcatctgtcagatccagtgtattcctaagctgggacaaagcctctgttttcccagtaggagccagggctgagtgtggaaattacagtgactgcttcttctcagcttctctggttgaaagcaagctggcgaagtaagaggaggtagagttgagaaggtgtggaagatagggacagctgcccccagaactcccttcaagggaggacttccccagctatgggaagtgccatcagggtggccgcagctgcagagagccacttcacctgagaccacgcccttcctggggcagcctgtatctggtgtctgagtgaggcatggtataaacacctggtcatttcaatccaacatgggacggacactgacagacagtactcccagcaggcccaggccagccagggcttcgtcaggcctgcagcacaatttgacttcctatgcccaggcctgcttcctcttcttcctcttcttttcacaggtgcttattcctaataaacatcttgcaaccc

SEQ ID NO: 29965 - DNA, 2868 bp, Homo sapiens
tcggcggccgggcggggagcggcgcgcgcgggccgcggcggagccagaggctgcaggaagagcccgcgggggcccggagggtgcgattcctcggcccccgcaaaacaatgtgtgttgtgagccaggacgcaacttgccggaggcggcgggggcgcgccgagcccgcctgagaccgcgctgcctcctcccccacccccagccgcggaggatgcggacggcccccggcggcgtctagcggccccgggcccaggcgcgatggtgcagcagcggggcgcgagggccaagcgggacggcgggccgccgcccccgggacccgggccggccgaggagggggcgcgcgagcccggctggtgcaagaccccgagcggccacatcaagaggccgatgaacgcattcatggtgtggtcgcagcacgaacggcggaagatcatggaccagtggcccgacatgcacaacgccgagatctccaagcgcctgggccgccgctggcagctgctgcaggactcggagaagatcccgttcgtgcgggaggcggagcggctgcggctcaagcacatggcggattacccggactacaagtaccggccgcgcaaaaagagcaagggggcgcccgccaaggcgcggccccgcccccccggtggtagcggtggcggcagccggctcaagcccgggccgcagctgcctggccgcgggggccgccgagcagcgggagggcctttggggggcggggcggcggcgcccgaggacgacgatgaagacgacgacgaggagctgctggaagtgcgcctggtcgagaccccggggcgggagctgtggaggatggtcccggcgggacgggccgctcggggacaagcggagcgcgcccaagggccgtcgggcgagggggcggccgccgccgccgccgcctccccgacaccgtcggaggacgaggagccggaggaagaggaggaggaggcggcagcggctgaggaaggtgaagaggagacggtggcgtcgggggaggagtcgctgggctttctgtccaggctgccccctggcccggccggcctggactgcagcgccctggatcgcgacccggacctgcagcctccctcgggcacgtcgcacttcgagttcccggactactgcacccccgaggttaccgagatgatcgcgggggactggcgcccgtctagcatcgcagacctggttttcacctactgagcccaccgtcagcggggcgcgcacgcccccaaaccagctgtttacatacaggaatcaggtattggggcccctcggaggccgaggctggcaccccatctcccgcgcagcctgccccctcctggacgtgcccatcccccctcagatccagacatgcccctcccccgcagacacaccccaaggcagcccaacccccaccccttccccgacacccaagcccctccccacgtcgccccctcctgcacagccaccagcagccagccccctccgatacacctcccgtcctctcctacagacctgcacccctccccccttttgcacacgcccctcctcgtggccggaggacccgccccctcctttgctccggaatctctcctccctcgcccggcccgccttctctgggttaggggggcgatgcggccgggtggcaacgcacgcgcctcctgcgcccctcccttccctggggggaggggcgcaccccttttatccccggagcgctagggcccgcccctccgctggggcccacccccttcgtgcgcatgcttaatgcttctggggaggagggggctggtcccagcggagccgcactcttcgcccgctccgggcaaaagcgggggcgagtgtagagcgatcctgggaaatcctttgatccgggagccctaggtttcctctccagccaacggggcgtcgctgccttaatgggaggagcactcggaagggttggtttgggcctgaaactctcccaagtggcatagccccttttccggtatggggtctcctacacccacgcgcaccacctctccggtcgcgtggctgcctctacagcctacctatacgtccctttttccccccaactgggaattgagaggtaaggtctttctctggaaatccagcagtagaggaagggaccacccaagaaaactaaaaaccaaggcaccttaccagtctgtctggggacaggatccctgctgcaccttccccaccccctcctgggaagtgccccctcacctcagggcacccgcaacctgggctcctccctgagcgcaccggcccttcctgtcacccaggtccaccctcagtactcaagctgcagtatacagcgggaaaaactgaggcactttggtgctaggggtttgggactgaggcgtggagagcagatgtgatggcaggaagactctcgcttttaaacatctggtttgggagagaccatcgacttggccagtgagactgagaatggattccgagtagtgatgggccgtttgcacctcggtttttccacgtgagaaatggggagaacgctgctgttaggaggaagttgtgtccagttcagggtgccctcgggagccctgtccctgttgctgtggcccctctcacgccgccatctctctgccccgccccgcccctccggcctccccacaccccccttgccctcactacctgtatctcaccggcgtgtgttcaccctcccgggtggctcacacactctcattcacacacacaaatctcaggaacaaacggtcccagagtcctccggacccctgcccagggtctctgcaggtctctgccccacgcgttcccgtcgctgacaaagccaccagctgcctcctttaagcttggtgctccggctctgggcctttcttgcgctctatttttttttttttttttttt

SEQ ID NO: 29966 - DNA, 3579 bp, Homo sapiens
ggcatgtgagcgggaagcctaggctgccagccgcgaggaccgcacggaggaggagcaggagcgcggagccgcgagccccgagccccgagcccggcgcctggctgagtagatgtccatgaggagccccatctctgcccagctggccctggatggcgttggcaccatggtgaactgcaccatcaagtcagaggagaagaaagagccttgccacgaggccccccagggctcagccactgccgctgaacctcagcctggagacccagcccgggcctcccaggatagtgctgacccccaagctccagcccaggggaatttcaggggctcctgggactgtagctctccagagggtaatgggtccccagaacccaagagaccaggagtgtcggaggctgcctctggaagccaggagaagctggacttcaaccgaaatttgaaagaagtggtgccagccatagagaagctgttgtccagtgactggaaggagaggtttctaggaaggaactctatggaagccaaagatgtcaaagggacccaagagagcctagcagagaaggagctccagcttctggtcatgattcaccagctgtccaccctgcgggaccagctcctgacagcccactcggagcagaagaacatggctgccatgctgtttgagaagcagcagcagcagatggagcttgcccggcagcagcaggagcagattgcaaagcagcagcagcagctgattcagcagcagcataagatcaacctccttcagcagcagatccagcaggttaacatgccttatgtcatgatcccagccttccccccaagccaccaacctctgcctgtcacccctgactcccagctggccttacccattcagcccattccctgcaaaccagtggagtatccgctgcagctgctgcacagcccccctgccccagtggtgaagaggcctggggccatggccacccaccaccccctgcaggagccctcccagcccctgaacctcacagccaagcccaaggcccccgagctgcccaacacctccagctccccaagcctgaagatgagcagctgtgtgccccgcccccccagccatggaggccccacgcgggacctgcagtccagccccccgagcctgcctctgggcttccttggtgaaggggacgctgtcaccaaagccatccaggatgctcggcagctgctgcacagccacagtggggccttggatggctcccccaacacccccttccgtaaggacctcatcagcctggactcatccccagccaaggagcggctggaggacggctgtgtgcacccactggaggaagccatgctgagctgcgacatggatggctcccgccacttccccgagtcccgaaacagcagccacatcaagaggcccatgaacgccttcatggtgtgggccaaggatgagcggaggaagatcctgcaagccttcccagacatgcacaactccagcatcagcaagatccttggatctcgctggaagtccatgaccaaccaggagaagcagccctactatgaggaacaggcgcggctgagccggcagcacctggagaagtatcctgactacaagtacaagccgcggcccaagcgcacctgcatcgtggagggcaagcggctgcgcgtgggagagtacaaggccctgatgaggacccggcgtcaggatgcccgccagagctacgtgatccccccgcaggctggccaggtgcagatgagctcctcagatgtcctgtaccctcgggcagcaggcatgccgctggcacagccactggtggagcactatgtccctcgtagcctggaccccaacatgcctgtgatcgtcaacacctgcagcctcagagaggagggtgagggcacagatgacaggcactcggtggctgatggcgagatgtaccggtacagcgaggacgaggactcggagggcgaagagaagagcgatggggagttggtggtgctcacagactgatcccggctgggtgggcctggccccttctcctctggggaagaccttgtcccaactcgatgggcacagccagccaacctaagactatgttggtacttggacttgttcgtgccccagagatgggcaaagctgtgcacttgcagatacattcatgaggggagaggcgccctcccttcctgaggagctgttggcctgggtgggcaggaactgcagtatggccatgggctgagcaggctgagcacctcagcctttagggcttatggccaggggacactgtatgactctcctctcctgcaggtgtctatccacctggggtatggcatctaccgacctgtctccctggggtcacatgctttgtttccattcttgtcctggctggaccagccactgtgggaccaacacccctcccacactcccccagactgctcgtctatcaccaggatcgctttgtactttgtgcaaaagggtctggctgtcccttgctgttttcatctctgccaagcctattgtgcctctggctgctgtatgtgtgcgcgtgcacgtgtgtgtgtttcatctgttcattcactgcacaagatatttattgagtgcccactacgtgccaggcactgttgctgagttcctgtgggtgtgtctctcgatgccactcctgcttctctgggggcctctttctgtgcttctctttgtccccaaattgctacctctttgtcagtctgggtgtctcaggttctgtgtgtccttgtgtgcatttctgtctctctctgtcctcgtctctctgcaaggccctctatttctctctttcttggtgtctgtcctttgccccctgtgccctctggattctctgggtctatgtaggcccctggtctgccctgggctcatcagccttcctgacctcctcctgccctccccttcactccctccctggctctgccagtcggttcccacggagccatttttagctctgatcagcatgggaatgtgcctcggcctccaaggggctttgtcctggtgcccccgcccctggtcccaacctgatcccacgagggagttgggacaggaggattgatggtgctccccttcctgccagcgtcagaggccctggagaggggctgtccatggcagctggtctttattcctccctcatgagcacagggtcgggggggtccccattcttggaagaggttgagaagactcctgggcttcagcctctcccacccagccctgcccctcacctgcctgccctcccctcccccactctatactagggactggatctcagcctctgatcagtttcacaaagtttgttccctaaggaaatcaaatcccattgtcacctaactctgaagatctaaatagcccttggatcagtatgggaaccccaaatcccacagggccagatgtggagtctgtgtctgcccccgtcttctctccatcctcaaagcccccacttctctccaggctgtttctttttttatgactgtaaacatagatagtgctttattttgttaataataagataatgatgagtaacttaaccagcacatttctcctgtttacactcgggggatttttttgttttctgatgacataataaagacagatca

SEQ ID NO: 29967 - DNA, 538 bp, Homo sapiens
acgcgggtcgagcttagggtgcacccccaacccgctcctcgccgaccgcagaggactaggtctttctcatcagcccgactatgcgcctagtttaaggatttctcagcgggaagccgaagcgacctgcgcgcgtcctgcgtggggctcaggtgcctgcgacgaggcgcagagctcctccaccatggttgcgtggggtgctgggggacagacgcgctccccttgccacggtttcagggtcgttccccagcggaccagaccagcgcggcatcctgtttgttttctgctccggctgctcctgtcccacccccacccccaccgcaggctgcttcttgctacccccacctcccgccctgggatatcgtaggatgtccatgaggagccccatctctgcccagctggccctggatggcgttggcaccatggtgaactgcaccatcaagtcagaggagaagaaagagccttgccacgaggccccccagggctcagccactgccgctgaacctcagcctggagacccagcccgggcctcccaggatag

SEQ ID NO: 29968 - DNA, 597 bp, Homo sapiens
agaactgttgggaggctaatggctgatgatgtctgcggcagcagtgctccatgaatggatgtccatgaggagccccatctctgcccagctggccctggatggcgttggcaccatggtgaactgcaccatcaagtcagaggagaagaaagagccttgccacgaggccccccagggctcagccactgccgctgaacctcagcctggagacccagcccgggcctcccaggatagtgctgacccccaagctccagcccaggggaatttcaggggctcctgggactgtagctctccagagggtaatgggtccccagaacccaagagaccaggagtgtcggaggctgcctctggaagccaggagaagctggacttcaaccgaaatttgaaagaagtggtgccagccatagagaagctgttgtccagtgactggaaggagaggtttctaggaaggaactctatggaagccaaagatgtcaaagggacccaagagagcctagcagagaaggagctccagcttctggtcatgattcaccagctgtccaccctgcgggaccagctcctgacagcccactcggagcagaagaacatggctgccatgct

SEQ ID NO: 29969 - DNA, 818 bp, Homo sapiens
tgcagaacccttgcactccctacccccacccacctagccgccgggaccatgtccaaaccttcagaccacatcaagcggcccatgaacgccttcatggtatggtcccggggccagcggcgcaagatggcccaggaaaaccccaagatgcacaactcggagatcagcaaacgcctaggtgccgaatggaagcttctgtccgaggcagagaagcggccatacatcgatgaagccaagcggctacgcgcccagcacatgaaggagcaccctgactacaagtaccgacctcggcgcaagcccaagaacctgctcaagaaggacaggtatgtcttccccttgccctacctgggcgacacggacccgctcaaggcggctggcctgcccgtgggggcctccgacggcctcctgagcgcgcccgagaaagcccgggccttcttgccgccggcctcggcgccctactccctgctggaccccgcgcagtttagctcgagcgccatccagaagatgggcgaagtgccccacaccttggctaccggcgctctgccctacgcgtccaccctgggctaccagaacggcgccttcggcagcctcagctgccccagccagcacacgcacacgcacccgtcccccaccaaccctggctacgtggtgccctgtaactgtaccgcctggtctgcctccaccctgcagccccccgtcgcctacatcctcttcccaggcatgaccaagactggcatagacccttattcgtcagcccacgctacggccatgtaacccccagcccggcccggacctgaggcgtggtctgaaagccgggtctg

SEQ ID NO: 29970 - DNA, 1394 bp, Homo sapiens
ttaaggaggtgcagtcttatgggagggacaggggcggagtcagtctttaaaagctgttcccaggtctggcccgcctgccacaaacgctgagcccaggtgggagaggtctggcctatccgcgcctggcagctgtcggaactccggagaccacaaaggggtttatggtttaccccctccacggaaggtcggtctgatcgcagctgcgggtcggggagagggaccgggggtcccccagtcagtaggcctcagaacacctcttcagtgccggggcaccagacagcggattttgcattcgactctccccaaagtgtgccgaacaggttggaagcaaaggctccggtttaagctctgggcttggggataaaatacactttttaaggacccaagttcctcggcaacgactccagactgggaagacctttccattttcaggatcgacgcttcacgttgaggggagggcattcaggacgccctcttaaggcttctcccaacccatggcgctaccaggctcctcacaggaccaggcctggagcctggagcctccggctgccacggctgctgcctcctcatcttcgggaccccaggagcgggagggcgctgggagccccgcggcccccgggacgctgcccctggagaaggtgaagcggccgatgaacgcgttcatggtgtggagctccgctcagcgccgccagatggcgcagcagaaccccaagatgcacaactccgagatctccaagcgcctgggcgcgcagtggaagctgctggacgaggacgagaagcggcccttcgtggaggaggccaagcggctccgcgcccgacacctgcgcgactaccccgactacaagtaccggcctcggcgcaaggccaagagctcgggcgccggaccttcccgctgcggacagggaagaggcaacctggccagcggcggcccgctctgggggccggggtacgcgaccacccaaccgagcagaggctttgggtacagaccccccagctactcgacagcctacctgcctggcagctatggctcttcccactgcaaactggaagccccctcaccgtgctccctccctcagagtgaccctaggctccagggggaactgctgcccacctatacccactacctgccccctggctctcccactccatacaaccctccccttgctggtgcccccatgcccctaacccacctctaaccctcatggacgcagacctcacgggacgggcctcatcctccttttttaatccagcagcatcccctaccccaggctgtcaaccctttctcctgttggactacagttcagaggcagcctgcagtcctcccatgatagccagggagagccgcacaacatacaattatatttttggtagtattaaacagttttgtattattc

SEQ ID NO: 29971 - DNA, 1048 bp, Homo sapiens
gggagaggtctggcctatccgcgcctggcagctgtcggaactccggagaccacaaaggggtttatggtttaccccctccacggaaggatcgacgcttcacgttgaggggagggcattcaggacgccctcttaaggcttctcccaacccatggcgctaccaggctcctcacaggaccaggcctggagcctggagcctccggctgccacggctgctgcctcctcatcttcgggaccccaggagcgggagggcgctgggagccccgcggcccccgggacgctgcccctggagaaggtgaagcggccgatgaacgcgttcatggtgtggagctccgctcagcgccgccagatggcgcagcagaaccccaagatgcacaactccgagatctccaagcgcctgggcgcgcagtggaagctgctggacgaggacgagaagcggcccttcgtggaggaggccaagcggctccgcgcccgacacctgcgcgactaccccgactacaagtaccggcctcggcgcaaggccaagagctcgggcgccggaccttcccgctgcggacagggaagaggcaacctggccagcggcggcccgctctgggggccggggtacgcgaccacccaaccgagcagaggctttgggtacagaccccccagctactcgacagcctacctgcctggcagctatggctcttcccactgcaaactggaagccccctcaccgtgctccctccctcagagtgaccctaggctccagggggaactgctgcccacctatacccactacctgccccctggctctcccactccatacaaccctccccttgctggtgcccccatgcccctaacccacctctaaccctcatggacgcagacctcacgggacgggcctcatcctccttttttaatccagcagcatcccctaccccaggctgtcaaccctttctcctgttggactacagttcagaggcagcctgcagtcctcccatgatagccagggagagccgcacaacatacaattatatttttggtagtattaaacagttttgtattattc

SEQ ID NO: 29972 - DNA, 2342 bp, Homo sapiens
gcagtgtcactaggccggctgggggccctgggtacgctgtagaccagaccgcgacaggccagaacacgggcggcggcttcgggccgggagacccgcgcagccctcggggcatctcagtgcctcactccccaccccctcccccgggtcgggggaggcggcgcgtccggcggagggttgaggggagcggggcaggcctggagcgccatgagcagcccggatgcgggatacgccagtgacgaccagagccagacccagagcgcgctgcccgcggtgatggccgggctgggcccctgcccctgggccgagtcgctgagccccatcggggacatgaaggtgaagggcgaggcgccggcgaacagcggagcaccggccggggccgcgggccgagccaagggcgagtcccgtatccggcggccgatgaacgctttcatggtgtgggctaaggacgagcgcaagcggctggcgcagcagaatccagacctgcacaacgccgagttgagcaagatgctgggcaagtcgtggaaggcgctgacgctggcggagaagcggcccttcgtggaggaggcagagcggctgcgcgtgcagcacatgcaggaccaccccaactacaagtaccggccgcggcggcgcaagcaggtgaagcggctgaagcgggtggagggcggcttcctgcacggcctggctgagccgcaggcggccgcgctgggccccgagggcggccgcgtggccatggacggcctgggcctccagttccccgagcagggcttccccgccggcccgccgctgctgcctccgcacatgggcggccactaccgcgactgccagagtctgggcgcgcctccgctcgacggctacccgttgcccacgcccgacacgtccccgctggacggcgtggaccccgacccggctttcttcgccgccccgatgcccggggactgcccggcggccggcacctacagctacgcgcaggtctcggactacgctggccccccggagcctcccgccggtcccatgcacccccgactcggcccagagcccgcgggtccctcgattccgggcctcctggcgccacccagcgcccttcacgtgtactacggcgcgatgggctcgcccggggcgggcggcgggcgcggcttccagatgcagccgcaacaccagcaccagcaccagcaccagcaccaccccccgggccccggacagccgtcgccccctccggaggcactgccctgccgggacggcacggaccccagtcagcccgccgagctcctcggggaggtggaccgcacggaatttgaacagtatctgcacttcgtgtgcaagcctgagatgggcctcccctaccaggggcatgactccggtgtgaatctccccgacagccacggggccatttcctcggtggtgtccgacgccagctccgcggtatattactgcaactatcctgacgtgtgacaggtccctgatccgccccagcctgcaggccagaagcagtgttacacacttcctggaggagctaaggaaatcctcagactcctgggtttttgttgttgctgttgttgttttttaaaaggtgtgttggcatataatttatggtaatttattttgtctgccacttgaacagtttgggggggtgaggtttcatttaaaatttgttcagagatttgtttcccatagttggattgtcaaaaccctatttccaagttcaagttaactagctttgaatgtgtcccaaaacagcttcctccatttcctgaaagtttattgatcaaagaaatgttgtcctgggtgtgttttttcaatcttctaaaaaataaaatctggaatcctgcttttttgctctactagtacctctgtcacactagtcttatcaaaaaccagttcttaagatcaatgttaagtttattagttaatgtaaatttctcatcctcgaaaagggtgaacataaatgcctttaaggagtatatctaaaaataaacattaggatatctaagtttgatgtaattgtttcaggaaggaaaaaagaaaagcattctggaatgagcctacttcaagtaatcttagtttctaaaactaacagttaatattttcaattccagtatatcactttaagtagaaggggatgtccaagtaattttggttttctaactgttgaatcataagcttgacctgcccccagaggctttttggatgtttttatctgtgttttgccatctctttacactcctcgacattcagtttaccttaatcttcacatttttacaccttgggaagtggcaagcatcgctgggtttaagataaaggagtcacaaaaactaatcaaaataaaatttgcattatgacaactt

SEQ ID NO: 29973 - DNA, 1723 bp, Homo sapiens
ccaccgccgtccccaccgccatccgccctcccggcctggcctgcccttgcgcccggctccccagtgcccgccgcccgcccgccgcgctcccgcgctccgttccgcccaggccgcgcccagctggaatgcagagatcgccgcccggctacggcgcacaggacgacccgcccgcccgccgcgactgtgcatgggccccgggacacggggccgccgctgacacgcgcggcctcgccgccggccccgccgccctcgccgcgcccgccgcgcccgcctcgccgcccagcccgcagcgcagtcccccgcgcagccccgagccggggcgctatggcctcagcccggccggccgcggggaacgccaggcggcagacgagtcgcgcatccggcggcccatgaacgccttcatggtgtgggcaaaggacgagcgcaagcggctggctcagcagaacccggacctgcacaacgcggtgctcagcaagatgctgggcaaagcgtggaaggagctgaacgcggcggagaagcggcccttcgtggaggaagccgaacggctgcgcgtgcagcacttgcgcgaccaccccaactacaagtaccggccgcgccgcaagaagcaggcgcgcaaggcccggcggctggagcccggcctcctgctcccgggattagcgcccccgcagccaccgcccgagcctttccccgcggcgtctggctcggctcgcgccttccgcgagctgcccccgctgggcgccgagttcgacggcctggggctgcccacgcccgagcgctcgcctctggacggcctggagcccggcgaggctgccttcttcccaccgcccgcggcgcccgaggactgcgcgctgcggcccttccgcgcgccctacgcgcccaccgagttgtcgcgggaccccggcggttgctacggggctcccctggcggaggcgctcaggaccgcgccccccgcggcgccgctcgctggcctgtactacggcaccctgggcacgcccggcccgtaccccggcccgctgtcgccgccgcccgaggccccgccgctggagagcgccgagccgctggggcccgccgccgatctgtgggccgacgtggacctcaccgagttcgaccagtacctcaactgcagccggactcggcccgacgcccccgggctcccgtaccacgtggcactggccaaactgggcccgcgcgccatgtcctgcccagaggagagcagcctgatctccgcgctgtcggacgccagcagcgcggtctattacagcgcgtgcatctccggctaggccgccggcgccgcccgggtccctgcagcgcttcctcccgcagcccccgcgaccgatccgaccgcgtcgctgccgctctgctctctcatacgcgtgtatgtttggttccatgtcacagccccctaggagccagtgatgctcggccttgcgcccgttccacctcccaggccacccttcctgggcttctgggccacctgccctcggggggcccctgcgagggtgcctggagttcccacgtgtcccggggcttttccaggaagcccgagcccaggacctgttggcagagttgccagggttacatttttgaagcacctgctccttttcttgcagtgtattttctacaaccagattgtattaatattttttactttgcccttttaaaaaatatacctaatacaatatatttaatttttaattaaactcttaaacttttcttccaagaa

SEQ ID NO: 29974 - DNA, 2504 bp, Homo sapiens
ctccgcgggcagccaacattgatttcctccgggccgagggcgagggcccgggaggcggcgggctgcagccgcggcagggcgagagcatgtccaagccggtggaccacgtcaagcggcccatgaacgccttcatggtgtggtcgcgggctcagcggcgcaagatggcccaggagaaccccaagatgcacaactcggagatcagcaagcgcttgggcgccgagtggaaactgctcacagagtcggagaagcggccgttcatcgacgaggccaagcgtctacgcgccatgcacatgaaggagcaccccgactacaagtaccggccgcggcgcaagcccaagacgctgctcaagaaggacaagttcgccttcccggtgccctacggcctgggcggcgtggcggacgccgagcaccctgcgctcaaggcgggcgccgggctgcacgcgggggcgggcggcggcctggtgcctgagtcgctgctcgccaatcccgagaaggcggccgcggccgccgccgctgccgccgcacgcgtcttcttcccgcagtcggccgctgccgccgccgctgccgccgccgccgccgccgcgggcagcccctactcgctgctcgacctgggctccaaaatggcagagatctcgtcgtcctcgtccggcctcccgtacgcgtcgtcgctgggctacccgaccgcgggcgcgggcgccttccacggcgcggcggcggcggctgcagcggcggccgccgccgccggggggcacacgcactcgcaccccagcccgggcaacccgggctacatgatcccgtgcaactgcagcgcgtggcccagccccgggctgcagccgccgctcgcctacatcctgctgccgggcatgggcaagccccagctggacccctaccccgcggcctacgctgccgcgctatgaccccgcggggccgcctcgcgaggaccggtgtgcacacgtgtacatatgtataggtacgagcgctgcggcctccccgtgcgccctcccgcgaccgggggcccggtttgtatgtacatagaatgtataggtgccaggtagaggcagagaggccaggcggggcaggagtggccaagcgcgcaagggcgcgggcgagcaggcctgtgaattcgcaggatcatttcagacccgcacttcggcagccaactcgaaagcaggcggttgtgtgcggcagcagttggcgtttgctttgcacttcggaacctgttgcgttttgacccacggaggtggaggagtaactttttgacatgttggcctttccagttttgttggaagtttcatggtcggttttgtttttgtttctcattcttcttcctcgcccctcagccccccaacccccaaccccctcccggtccgtgttgcatgcacgctgttcaaatgtgaggtctgaaatggctggcacacgggaaaagctgcttgtgtcattcgtttctgggagtgggatggctctgagcagcctcgcctccctgtttgtactatttgaactttgcagatctctgttctctcaagcagaactcccaaccagatccattcttgaccagtgaccggctcgaatctggccttttgtgtgagatgatcacggtttcttttgtttatcacgccatttgcaaatcagagcaagagctctttctcaagggcaagaaacgcaaacaagaaatatttgtgagatgaaagttgtcaattggattttcttcctaaacaaacaacaacaacaaactactagaagtctccctgagtccactcgcttggatttctgacacagtttacaaaaaaggaaaaaggcactgctcctattttcccttatggctgagttcaccttaagattgtaaatgtgtatatgtcagtgaaaacattgaggcttggaaaatgtgttattttcgttgccctaagtttgagtcgactttagactcaaaaacattttgagcgaatatcaaagttaacttttaaaaattgcgaaactatttcagaatcgcaattttatcgaagattaaatcagacttttttgtctggtaattatatatttattatttagcaaaactgaagaaaaaaagcacagaattgtttcaacagatgtctctcattttcagctagcatttctctcccaagttgagctggtttaatgtgttttggatttccctcctcaattggcttattttttagatcacctgcaattcatttgcaaattgcaataaaacacattttagaaaaaaggaaccttcaattattagctttgtttctttttaaatgtatatattttgactaatgtttgtgaatgaagttggctaacatgtatttagtttcattttggctttatgtaatataaagtttttaaaattttaaatatggttttaacctttatgtgtaaatgattttctagtgtgaccttctaatttaatattagacgtctaaggtatatctgtaaattagaatccgactatcactctgttcattttttttgaacaaagagtttaaataaagcctgaaccaggg

SEQ ID NO: 29975 - DNA, 2074 bp, Homo sapiens
atgcgacctgttcgagagaactcatcaggtgcgagaagcccgcgggttcctgctgatttggcgcggagcattttgataagcctacccttcccgccggactcgctggcccacaggcccccaagctccgctccgacggagtcccagggccttttcaccgtggccgctccagccccgggagcgccttctcctcccgccacgctggcgcaccttcttcccgccccggcaatgtacagccttctggagactgaactcaagaaccccgtagggacacccacacaagcggcgggcaccggcggccccgcagccccgggaggcgcaggcaagagtagtgcgaacgcagccggcggcgcgaactcgggcggcggcagcagcggtggtgcgagcggaggtggcgggggtacagaccaggaccgtgtgaaacggcccatgaacgccttcatggtatggtcccgcgggcagcggcgcaaaatggccctggagaaccccaagatgcacaattctgagatcagcaagcgcttgggcgccgactggaaactgctgaccgacgccgagaagcgaccattcatcgacgaggccaagcgacttcgcgccgtgcacatgaaggagtatccggactacaagtaccgaccgcgccgcaagaccaagacgctgctcaagaaagataagtactccctgcccagcggcctcctgcctcccggtgccgcggccgccgccgccgctgccgcggccgcagccgctgccgccagcagtccggtgggcgtgggccagcgcctggacacgtacacgcacgtgaacggctgggccaacggcgcgtactcgctggtgcaggagcagctgggctacgcgcagcccccgagcatgagcagcccgccgccgccgcccgcgctgccgccgatgcaccgctacgacatggccggcctgcagtacagcccaatgatgccgcccggcgctcagagctacatgaacgtcgctgccgcggccgccgccgcctcgggctacgggggcatggcgccctcagccacagcagccgcggccgccgcctacgggcagcagcccgccaccgccgcggccgcagctgcggccgcagccgccatgagcctgggccccatgggctcggtagtgaagtctgagcccagctcgccgccgcccgccatcgcatcgcactctcagcgcgcgtgcctcggcgacctgcgcgacatgatcagcatgtacctgccacccggcggggacgcggccgacgccgcctctccgctgcccggcggtcgcctgcacggcgtgcaccagcactaccagggcgccgggactgcagtcaacggaacggtgccgctgacccacatctgagcaccggcctgcgctcgtccacccttgttccccacccccacccccactcccgccccgcacccccaagttgggacgccttgtttagctttgcttgcctgggactgttgccttgtaccgatgatggggagggctgaaagttttgctgtagctgtcgggttttgtacaaaagcaaaaataagtcaggagcagcgaaaatgggacttctagagagctctcttgccccacgccgctgctcctttcacctttgtaggctgggaatcgctgtgttatttgcaaagaaaaaacagcccccactcctcctcctgagttccagggttattctgttacatttgaaaatgttgtcttgttagtttgcagttagccaaggagtgaatgggagaaacatagtatcgggtgaggccagctggagaactgcaacgcctacgcccccagtcgtgtcgcgtctgttttcctcgtggttttttggggcgctgaccgctccaagcagcgcggcagctaaagccaatgttaatttatagccaggtgtgcgtgtgtctcccgcctcgccgcccctggccgcgggacagcttctgtccaatcatgttgagttggtgatttctgccgtgatctgtttgatatttcttcgcgctaatgtgttcagatttcgtttgggtagtggggaggggctactttgtttcagggttttcaagcttttactcttaattcctaaatgagatcaataaattttataacc

SEQ ID NO: 29976 - DNA, 4315 bp, Homo sapiens
gagaaaatcaattggtttagaaggtttggactcacttgacaggttcagttggagacgatcataggtggctgctgtgacaaagggaaattgtgcttttccagcatgcttactgaccctgatttacctcaggagtttgaaaggatgtcttccaagcgaccagcctctccgtatggggaagcagatggagaggtagccatggtgacaagcagacagaaagtggaagaagaggagagtgacgggctcccagcctttcaccttcccttgcatgtgagttttcccaacaagcctcactctgaggaatttcagccagtttctctgctgacgcaagagacttgtggccataggactcccacttctcagcacaatacaatggaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacgagccggaagaaacccccagtattgaaaaactactctcaaaggactggaaagacaagcttcttgcaatgggatcggggaactttggcgaaataaaagggactcccgagagcttagctgagaaagaaaggcaactcatgggtatgatcaaccagctgaccagcctccgagagcagctgttggctgcccacgatgagcagaagaaactagctgcctctcagattgagaaacagcgtcagcaaatggagctggccaagcagcaacaagaacaaattgcaagacagcagcagcagcttctacagcaacaacacaaaatcaatttgctccagcaacagatccaggttcaaggtcagctgccgccattaatgattcccgtattccctcctgatcaacggacactggctgcagctgcccagcaaggattcctcctccctccaggcttcagctataaggctggatgtagtgacccttaccctgttcagctgatcccaactaccatggcagctgctgccgcagcaacaccaggcttaggcccactccaactgcagcagttatatgctgcccagctagctgcaatgcaggtatctccaggagggaagctgccaggcataccccaaggcaaccttggtgctgctgtatctcctaccagcattcacacagacaagagcacaaacagcccaccacccaaaagcaaggatgaagtggcacagccactgaacctatcagctaaacccaagacctctgatggcaaatcacccacatcacccacctctccccatatgccagctctgagaataaacagtggggcaggccccctcaaagcctctgtcccagcagcgttagctagtccttcagccagagttagcacaataggttacttaaatgaccatgatgctgtcaccaaggcaatccaagaagctcggcaaatgaaggagcaactccgacgggaacaacaggtgcttgatgggaaggtggctgttgtgaatagtctgggtctcaataactgccgaacagaaaaggaaaaaacaacactggagagtctgactcagcaactggcagttaaacagaatgaagaaggaaaatttagccatgcaatgatggatttcaatctgagtggagattctgatggaagtgctggagtctcagagtcaagaatttatagggaatcccgagggcgtggtagcaatgaaccccacataaagcgtccaatgaatgccttcatggtgtgggctaaagatgaacggagaaagatccttcaagcctttcctgacatgcacaactccaacatcagcaagatattgggatctcgctggaaagctatgacaaacctagagaaacagccatattatgaggagcaagcccgtctcagcaagcagcacctggagaagtaccctgactataagtacaagcccaggccaaagcgcacctgcctggtggatggcaaaaagctgcgcattggtgaatacaaggcaatcatgcgcaacaggcggcaggaaatgcggcagtacttcaatgttgggcaacaagcacagatccccattgccactgctggtgttgtgtaccctggagccatcgccatggctgggatgccctcccctcacctgccctcggagcactcaagcgtgtctagcagcccagagcctgggatgcctgttatccagagcacttacggtgtgaaaggagaggagccacatatcaaagaagagatacaggccgaggacatcaatggagaaatttatgatgagtacgacgaggaagaggatgatccagatgtagattatgggagtgacagtgaaaaccatattgcaggacaagccaactgataagggtcaaaagattgttgtgaccttaggacttaaagaagccctaactggttcatccttaccagtggccaagcacattaactttctcatacactgactgttactttaactgttagtcttaaatagttgggacatcagctgactaatagacctcagcctcaaaaggcttggaaagaaaaaacaaatacaacaagcaaacaacaatatcaacaacaagagattgaaataagctatgggtaaaataatgccagtaattcagctgctacatccaagcactgaagtcttacccgtcaacttttttttttttttaaataaactttatggctgtttgttctacaatgttctagaaattctcactcaggtacacagtgccaacaagtggcttgtgaatgtgttttgttgttttgtgctacaatttttaaaaagaaaaaagttttgttttgttttttggggtttctgggttttttccttttctttttctttcctttcattttttttctttgtaatgcacctgacagaaaaaaaagaaaaatgaatttctctttacttctctccaccttctccatctctctactttaaagatggaagtctgtgcatgaggggaaagagggaaaaagagcctgtttttaacttccttgctatccaccacaaaataagcaattattttctttagaggactttatctattgcacaccacactacatctttgagcaagtgccaaatttgtactgaagtgttgaccaagttcattttttctctttactttttccttttccttcttaagttaggacagtgttaaatcttagacaatcccttgaaaaacctgaaataccagcagctggtgagatttgacttttttttttaatggaaactgtaggtgctgttctcaggtgaaaagagagagagagagagagacataagaaatttagagaaaaatattttctgatcttggatttttgtgtgtatgtatgtatgtgattatggtactaataataggaataacgttggaccattgtgagttaaacccacatctggggatgaaatcccacatcctcccaagtgactggtctagaaataatcttgaccttgactttgcacttcaaatgacaacttaaccaagtatagggctcagaaattatatttttaaatgtctgattattattggatggatcaggtggccctgtgtaatagaggtgtgcatgtataacatggaagctactagcaaactgctcccagatgtcctttctccctggtcagttggttccattaacgtttgctacttagtgatttttgtttttcctgttgatattttgagcaaaacaatcattgttttcattgaatatatttggccattttttcagacaaatagaattagcttatttcttcaacattccatcctttcccgatcaggaaatgaaactgatgattttataaggtatttttcacccctccatgaagtgaggtggaggcctttagcatttcagaagtgtgggccatatgtagttcatgccataaaaagtaggatttaattaaaagtcattgcagcccaataaaatggagcctggctgcacccagggatccttgccactgctcttcccttgctgtcagattaatccactgaagtccaactttggttcaagcagagtatttgcaaagagcaacaactgaatgtgatgggactgcttatgtagattttgccagccaaatgccaaggcagttgtagggcctgtacaaataaatgcaaaatcatttcaagtcaattgccattatttgtattgaagtatcagatagatagtaaatactgcaactagtagcttgatgtgctatagttttcactccagtcatcattttcctatctcaccccccgaaacaccaccctaaagttggatttttacatataaataaaaaaagaatccctttt

SEQ ID NO: 29977 - DNA, 3991 bp, Homo sapiens
gagaaaatcaattggtttagaaggtttggactcacttgacaggttcagttggagacgatcataggtggctgctgtgacaaagggaaattgtgcttttccagcatgcttactgaccctgatttacctcaggagtttgaaaggatgtcttccaagcgaccagcctctccgtatggggaagcagatggagaggtagccatggtgacaagcagacagaaagtggaagaagaggagagtgacgggctcccagcctttcaccttcccttgcatgtgagttttcccaacaagcctcactctgaggaatttcagccagtttctctgctgacgcaagagacttgtggccataggactcccacttctcagcacaatacaatggaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacgagccggaagaaacccccagtattgaaaaactactctcaaaggactggaaagacaagcttcttgcaatgggatcggggaactttggcgaaataaaagggactcccgagagcttagctgagaaagaaaggcaactcatgggtatgatcaaccagctgaccagcctccgagagcagctgttggctgcccacgatgagcagaagaaactagctgcctctcagattgagaaacagcgtcagcaaatggagctggccaagcagcaacaagaacaaattgcaagacagcagcagcagcttctacagcaacaacacaaaatcaatttgctccagcaacagatccaggttcaaggtcagctgccgccattaatgattcccgtattccctcctgatcaacggacactggctgcagctgcccagcaaggattcctcctccctccaggcttcagctataaggctggatgtagtgacccttaccctgttcagctgatcccaactaccatggcagctgctgccgcagcaacaccaggcttaggcccactccaactgcagcagttatatgctgcccagctagctgcaatgcaggtatctccaggagggaagctgccaggcataccccaaggcaaccttggtgctgctgtatctcctaccagcattcacacagacaagagcacaaacagcccaccacccaaaagcaaggaaaaaacaacactggagagtctgactcagcaactggcagttaaacagaatgaagaaggaaaatttagccatgcaatgatggatttcaatctgagtggagattctgatggaagtgctggagtctcagagtcaagaatttatagggaatcccgagggcgtggtagcaatgaaccccacataaagcgtccaatgaatgccttcatggtgtgggctaaagatgaacggagaaagatccttcaagcctttcctgacatgcacaactccaacatcagcaagatattgggatctcgctggaaagctatgacaaacctagagaaacagccatattatgaggagcaagcccgtctcagcaagcagcacctggagaagtaccctgactataagtacaagcccaggccaaagcgcacctgcctggtggatggcaaaaagctgcgcattggtgaatacaaggcaatcatgcgcaacaggcggcaggaaatgcggcagtacttcaatgttgggcaacaagcacagatccccattgccactgctggtgttgtgtaccctggagccatcgccatggctgggatgccctcccctcacctgccctcggagcactcaagcgtgtctagcagcccagagcctgggatgcctgttatccagagcacttacggtgtgaaaggagaggagccacatatcaaagaagagatacaggccgaggacatcaatggagaaatttatgatgagtacgacgaggaagaggatgatccagatgtagattatgggagtgacagtgaaaaccatattgcaggacaagccaactgataagggtcaaaagattgttgtgaccttaggacttaaagaagccctaactggttcatccttaccagtggccaagcacattaactttctcatacactgactgttactttaactgttagtcttaaatagttgggacatcagctgactaatagacctcagcctcaaaaggcttggaaagaaaaaacaaatacaacaagcaaacaacaatatcaacaacaagagattgaaataagctatgggtaaaataatgccagtaattcagctgctacatccaagcactgaagtcttacccgtcaacttttttttttttttaaataaactttatggctgtttgttctacaatgttctagaaattctcactcaggtacacagtgccaacaagtggcttgtgaatgtgttttgttgttttgtgctacaatttttaaaaagaaaaaagttttgttttgttttttggggtttctgggttttttccttttctttttctttcctttcattttttttctttgtaatgcacctgacagaaaaaaaagaaaaatgaatttctctttacttctctccaccttctccatctctctactttaaagatggaagtctgtgcatgaggggaaagagggaaaaagagcctgtttttaacttccttgctatccaccacaaaataagcaattattttctttagaggactttatctattgcacaccacactacatctttgagcaagtgccaaatttgtactgaagtgttgaccaagttcattttttctctttactttttccttttccttcttaagttaggacagtgttaaatcttagacaatcccttgaaaaacctgaaataccagcagctggtgagatttgacttttttttttaatggaaactgtaggtgctgttctcaggtgaaaagagagagagagagagagacataagaaatttagagaaaaatattttctgatcttggatttttgtgtgtatgtatgtatgtgattatggtactaataataggaataacgttggaccattgtgagttaaacccacatctggggatgaaatcccacatcctcccaagtgactggtctagaaataatcttgaccttgactttgcacttcaaatgacaacttaaccaagtatagggctcagaaattatatttttaaatgtctgattattattggatggatcaggtggccctgtgtaatagaggtgtgcatgtataacatggaagctactagcaaactgctcccagatgtcctttctccctggtcagttggttccattaacgtttgctacttagtgatttttgtttttcctgttgatattttgagcaaaacaatcattgttttcattgaatatatttggccattttttcagacaaatagaattagcttatttcttcaacattccatcctttcccgatcaggaaatgaaactgatgattttataaggtatttttcacccctccatgaagtgaggtggaggcctttagcatttcagaagtgtgggccatatgtagttcatgccataaaaagtaggatttaattaaaagtcattgcagcccaataaaatggagcctggctgcacccagggatccttgccactgctcttcccttgctgtcagattaatccactgaagtccaactttggttcaagcagagtatttgcaaagagcaacaactgaatgtgatgggactgcttatgtagattttgccagccaaatgccaaggcagttgtagggcctgtacaaataaatgcaaaatcatttcaagtcaattgccattatttgtattgaagtatcagatagatagtaaatactgcaactagtagcttgatgtgctatagttttcactccagtcatcattttcctatctcaccccccgaaacaccaccctaaagttggatttttacatataaataaaaaaagaatccctttt

SEQ ID NO: 29978 - DNA, 1379 bp, Homo sapiens
aaacagtcagttatagtgggttcaccagactgttggagatttgtgccataggagctgtgcatgcatgatgaagtggcacagccactgaacctatcagctaaacccaagacctctgatggcaaatcacccacatcacccacctctccccatatgccagctctgagaataaacagtggggcaggccccctcaaagcctctgtcccagcagcgttagctagtccttcagccagagttagcacaataggttacttaaatgaccatgatgctgtcaccaaggcaatccaagaagctcggcaaatgaaggagcaactccgacgggaacaacaggtgcttgatgggaaggtggctgttgtgaatagtctgggtctcaataactgccgaacagaaaaggaaaaaacaacactggagagtctgactcagcaactggcagttaaacagaatgaagaaggaaaatttagccatgcaatgatggatttcaatctgagtggagattctgatggaagtgctggagtctcagagtcaagaatttatagggaatcccgagggcgtggtagcaatgaaccccacataaagcgtccaatgaatgccttcatggtgtgggctaaagatgaacggagaaagatccttcaagcctttcctgacatgcacaactccaacatcagcaagatattgggatctcgctggaaagctatgacaaacctagagaaacagccatattatgaggagcaagcccgtctcagcaagcagcacctggagaagtaccctgactataagtacaagcccaggccaaagcgcacctgcctggtggatggcaaaaagctgcgcattggtgaatacaaggcaatcatgcgcaacaggcggcaggaaatgcggcagtacttcaatgttgggcaacaagcacagatccccattgccactgctggtgttgtgtaccctggagccatcgccatggctgggatgccctcccctcacctgccctcggagcactcaagcgtgtctagcagcccagagcctgggatgcctgttatccagagcacttacggtgtgaaaggagaggagccacatatcaaagaagagatacaggccgaggacatcaatggagaaatttatgatgagtacgacgaggaagaggatgatccagatgtagattatgggagtgacagtgaaaaccatattgcaggacaagccaactgataagggtcaaaagattgttgtgaccttaggacttaaagaagccctaactggttcatccttaccagtggccaagcacattaactttctcatacactgactgttactttaactgttagtcttaaatagttgggacatcagctgactaatagacctcagcctcaaaaggcttggaaagaaaaaacaaa

SEQ ID NO: 29979 - DNA, 2942 bp, Homo sapiens
gcttactccctgaccagatgctgcggtgcacggggcagccaccatctctgcatgcatgtctgtgtaagtgtctctctctctgtgtgtatgtgcctctgtcatttcgtgtcaaaggtacattacctgattacctttctcggctgccagatttttatctagataattggaactgctatggaggctgtgccttgccagccagcttagaatctgtaaagccatagtttgtccaccttgttatctgtggctgcctgggcagaggaaattaaagagatccacagccaggggggcgcttcctactcctgacctccccagcgatcccaaacaggacagtttgttagtaccgtctttttgtttttatgttttgatttcgttttgggtttttgttcgctcgtgtatgttattttggcatgtggatacctattcccctccacatcgcacatcgtgttttatggagtttagagctgaggaaactttggtcgggttgccaggacgttcgcaccactttgcggaaagcacgagctaacagtgagaccgacagagatgtcttccaagcgaccagcctctccgtatggggaagcagatggagaggtagccatggtgacaagcagacagaaagtggaagaagaggagagtgacgggctcccagcctttcaccttcccttgcatgaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacgagccggaagaaacccccagtattgaaaaactactctcaaaggactggaaagacaagcttcttgcaatgggatcggggaactttggcgaaataaaagggactcccgagagcttagctgagaaagaaaggcaactcatgggtatgatcaaccagctgaccagcctccgagagcagctgttggctgcccacgatgagcagaagaaactagctgcctctcagattgagaaacagcgtcagcaaatggagctggccaagcagcaacaagaacaaattgcaagacagcagcagcagcttctacagcaacaacacaaaatcaatttgctccagcaacagatccaggttcaaggtcagctgccgccattaatgattcccgtattccctcctgatcaacggacactggctgcagctgcccagcaaggattcctcctccctccaggcttcagctataaggctggatgtagtgacccttaccctgttcagctgatcccaactaccatggcagctgctgccgcagcaacaccaggcttaggcccactccaactgcagcagttatatgctgcccagctagctgcaatgcaggtatctccaggagggaagctgccaggcataccccaaggcaaccttggtgctgctgtatctcctaccagcattcacacagacaagagcacaaacagcccaccacccaaaagcaaggatgaagtggcacagccactgaacctatcagctaaacccaagacctctgatggcaaatcacccacatcacccacctctccccatatgccagctctgagaataaacagtggggcaggccccctcaaagcctctgtcccagcagcgttagctagtccttcagccagagttagcacaataggttacttaaatgaccatgatgctgtcaccaaggcaatccaagaagctcggcaaatgaaggagcaactccgacgggaacaacaggtgcttgatgggaaggtggctgttgtgaatagtctgggtctcaataactgccgaacagaaaaggaaaaaacaacactggagagtctgactcagcaactggcagttaaacagaatgaagaaggaaaatttagccatgcaatgatggatttcaatctgagtggagattctgatggaagtgctggagtctcagagtcaagaatttatagggaatcccgagggcgtggtagcaatgaaccccacataaagcgtccaatgaatgccttcatggtgtgggctaaagatgaacggagaaagatccttcaagcctttcctgatcttggatttttgtgtgtatgtatgtatgtgattatggtactaataataggaataacgttggaccattgtgagttaaacccacatctggggatgaaatcccacatcctcccaagtgactggtctagaaataatcttgaccttgactttgcacttcaaatgacaacttaaccaagtatagggctcagaaattatatttttaaatgtctgattattattggatggatcaggtggccctgtgtaatagaggtgtgcatgtataacatggaagctactagcaaactgctcccagatgtcctttctccctggtcagttggttccattaacgtttgctacttagtgatttttgtttttcctgttgatattttgagcaaaacaatcattgttttcattgaatatatttggccattttttcagacaaatagaattagcttatttcttcaacattccatcctttcccgatcaggaaatgaaactgatgattttataaggtatttttcacccctccatgaagtgaggtggaggcctttagcatttcagaagtgtgggccatatgtagttcatgccataaaaagtaggatttaattaaaagtcattgcagcccaataaaatggagcctggctgcacccagggatccttgccactgctcttcccttgctgtcagattaatccactgaagtccaactttggttcaagcagagtatttgcaaagagcaacaactgaatgtgatgggactgcttatgtagattttgccagccaaatgccaaggcagttgtagggcctgtacaaataaatgcaaaatcatttc

SEQ ID NO: 29980 - DNA, 4261 bp, Homo sapiens
gagaaaatcaattggtttagaaggtttggactcacttgacaggttcagttggagacgatcataggtggctgctgtgacaaagggaaattgtgcttttccagcatgcttactgaccctgatttacctcaggagtttgaaaggatgtcttccaagcgaccagcctctccgtatggggaagcagatggagaggtagccatggtgacaagcagacagaaagtggaagaagaggagagtgacgggctcccagcctttcaccttcccttgcatgtgagttttcccaacaagcctcactctgaggaatttcagccagtttctctgctgacgcaagagacttgtggccataggactcccacttctcagcacaatacaatggaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacgagccggaagaaacccccagtattgaaaaactactctcaaaggactggaaagacaagcttcttgcaatgggatcggggaactttggcgaaataaaagggactcccgagagcttagctgagaaagaaaggcaactcatgggtatgatcaaccagctgaccagcctccgagagcagctgttggctgcccacgatgagcagaagaaactagctgcctctcagattgagaaacagcgtcagcaaatggagctggccaagcagcaacaagaacaaattgcaagacagcagcagcagcttctacagcaacaacacaaaatcaatttgctccagcaacagatccaggttcaaggtcagctgccgccattaatgattcccgtattccctcctgatcaacggacactggctgcagctgcccagcaaggattcctcctccctccaggcttcagctataaggctggatgtagtgacccttaccctgttcagctgatcccaactaccatggcagctgctgccgcagcaacaccaggcttaggcccactccaactgcagcagttatatgctgcccagctagctgcaatgcaggtatctccaggagggaagctgccaggcataccccaaggcaaccttggtgctgctgtatctcctaccagcattcacacagacaagagcacaaacagcccaccacccaaaagcaaggatgaagtggcacagccactgaacctatcagctaaacccaagacctctgatggcaaatcacccacatcacccacctctccccatatgccagctctgagaataaacagtggggcaggccccctcaaagcctctgtcccagcagcgttagctagtccttcagccagagttagcacaataggttacttaaatgaccatgatgctgtcaccaaggcaatccaagaagctcggcaaatgaaggagcaactccgacgggaacaacaggtgcttgatgggaaggtggctgttgtgaatagtctgggtctcaataactgccgaacagaaaaggaaaaaacaacactggagagtctgactcagcaactggcagttaaacagaatgaagaaggaaaatttagccatgcaatgatggatttcaatctgagtggagattctgatggaagtgctggagtctcagagtcaagaatttatagggaatcccgagggcgtggtagcaatgaaccccacataaagcgtccaatgaatgccttcatggtgtgggctaaagatgaacggagaaagatccttcaagcctttcctgacatgcacaactccaacatcagcaagatattgggatctcgctggaaagctatgacaaacctagagaaacagccatattatgaggagcaagcccgtctcagcaagcagcacctggagaagtaccctgactataagtacaagcccaggccaaagcgcacctgcctggtggatggcaaaaagctgcgcattggtgaatacaaggcaatcatgcgcaacaggcggcaggaaatgcggcagtacttcaatgttgggcaacaagcacagatccccattgccactgctggtgttgtgtaccctggagccatcgccatggctgggatgccctcccctcacctgccctcggagcactcaagcgtgtctagcagcccagagcctgggatgcctgttatccagagcacttacggtgtgaaaggagaggagccacatatcaaagaagagatacaggccgaggacatcaatggagaaatttatgatgagtacgacgaggaagaggatgatccagatgtagattatgggagtgacagtgaaaaccatattgcaggacaagccaactgataagggtcaaaagattgttgtgaccttaggacttaaagaagccctaactggttcatccttaccagtggccaagcacattaactttctcatacactgactgttactttaactgttagtcttaaatagttgggacatcagctgactaatagacctcagcctcaaaaggcttggaaagaaaaaacaaatacaacaagcaaacaacaatatcaacaacaagagattgaaataagctatgggtaaaataatgccagtaattcagctgctacatccaagcactgaagtcttacccgtcaacttttttttttttttaaataaactttatggctgtttgttctacaatgttctagaaattctcactcaggtacacagtgccaacaagtggcttgtgaatgtgttttgttgttttgtgctacaatttttaaaaagaaaaaagttttgttttgttttttggggtttctgggttttttccttttctttttctttcctttcattttttttctttgtaatgcacctgacagaaaaaaaagaaaaatgaatttctctttacttctctccaccttctccatctctctactttaaagatggaagtctgtgcatgaggggaaagagggaaaaagagcctgtttttaacttccttgctatccaccacaaaataagcaattattttctttagaggactttatctattgcacaccacactacatctttgagcaagtgccaaatttgtactgaagtgttgaccaagttcattttttctctttactttttccttttccttcttaagttaggacagtgttaaatcttagacaatcccttgaaaaacctgaaataccagcagctggtgagatttgacttttttttttaatggaaactgtaggtgctgttctcaggtgaaaagagagagagagagagagacataagaaatttagagaaaaatattttctgatcttggatttttgtgtgtatgtatgtatgtgattatggtactaataataggaataacgttggaccattgtgagttaaacccacatctggggatgaaatcccacatcctcccaagtgactggtctagaaataatcttgaccttgactttgcacttcaaatgacaacttaaccaagtatagggctcagaaattatatttttaaatgtctgattattattggatggatcaggtggccctgtgtaatagaggtgtgcatgtataacatggaagctactagcaaactgctcccagatgtcctttctccctggtcagttggttccattaacgtttgctacttagtgatttttgtttttcctgttgatattttgagcaaaacaatcattgttttcattgaatatatttggccattttttcagacaaatagaattagcttatttcttcaacattccatcctttcccgatcaggaaatgaaactgatgattttataaggtatttttcacccctccatgaagtgaggtggaggcctttagcatttcagaagtgtgggccatatgtagttcatgccataaaaagtaggatttaattaaaagtcattgcagcccaataaaatggagcctggctgcacccagggatccttgccactgctcttcccttgctgtcagattaatccactgaagtccaactttggttcaagcagagtatttgcaaagagcaacaactgaatgtgatgggactgcttatgtagattttgccagccaaatgccaaggcagttgtagggcctgtacaaataaatgcaaaatcatttcaagtcaattgccattatttgtattgaagtatcagatagatagtaaatactgcaactagtagcttgatgtgctatagttttcactccagtcatcattttcctatctcaccccccg

SEQ ID NO: 29981 - DNA, 2365 bp, Homo sapiens
caggatgtcttccaagcgaccagcctctccgtatggggaagcagatggagaggtagccatggtgacaagcagacagaaagtggaagaagaggagagtgacgggctcccagcctttcaccttcccttgcatgtgagttttcccaacaagcctcactctgaggaatttcagccagtttctctgctgacgcaagagacttgtggccataggactcccacttctcagcacaatacaatggaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacgagccggaagaaacccccagtattgaaaaactactctcaaaggactggaaagacaagcttcttgcaatgggatcggggaactttggcgaaataaaagggactcccgagagcttagctgagaaagaaaggcaactcatgggtatgatcaaccagctgaccagcctccgagagcagctgttggctgcccacgatgagcagaagaaactagctgcctctcagattgagaaacagcgtcagcaaatggagctggccaagcagcaacaagaacaaattgcaagacagcagcagcagcttctacagcaacaacacaaaatcaatttgctccagcaacagatccaggttcaaggtcagctgccgccattaatgattcccgtattccctcctgatcaacggacactggctgcagctgcccagcaaggattcctcctccctccaggcttcagctataaggctggatgtagtgacccttaccctgttcagctgatcccaactaccatggcagctgctgccgcagcaacaccaggcttaggcccactccaactgcagcagttatatgctgcccagctagctgcaatgcaggtatctccaggagggaagctgccaggcataccccaaggcaaccttggtgctgctgtatctcctaccagcattcacacagacaagagcacaaacagcccaccacccaaaagcaaggaaaaaacaacactggagagtctgactcagcaactggcagttaaacagaatgaagaaggaaaatttagccatgcaatgatggatttcaatctgagtggagattctgatggaagtgctggagtctcagagtcaagaatttatagggaatcccgagggcgtggtagcaatgaaccccacataaagcgtccaatgaatgccttcatggtgtgggctaaagatgaacggagaaagatccttcaagcctttcctgacatgcacaactccaacatcagcaagatattgggatctcgctggaaagctatgacaaacctagagaaacagccatattatgaggagcaagcccgtctcagcaagcagcacctggagaagtaccctgactataagtacaagcccaggccaaagcgcacctgcctggtggatggcaaaaagctgcgcattggtgaatacaaggcaatcatgcgcaacaggcggcaggaaatgcggcagtacttcaatgttgggcaacaagcacagatccccattgccactgctggtgttgtgtaccctggagccatcgccatggctgggatgccctcccctcacctgccctcggagcactcaagcgtgtctagcagcccagagcctgggatgcctgttatccagagcacttacggtgtgaaaggagaggagccacatatcaaagaagagatacaggccgaggacatcaatggagaaatttatgatgagtacgacgaggaagaggatgatccagatgtagattatgggagtgacagtgaaaaccatattgcaggacaagccaactgataagggtcaaaagattgttgtgaccttaggacttaaagaagccctaactggttcatccttaccagtggccaagcacattaactttctcatacactgactgttactttaactgttagtcttaaatagttgggacatcagctgactaatagacctcagcctcaaaaggcttggaaagaaaaaacaaatacaacaagcaaacaacaatatcaacaacaagagattgaaataagctatgggtaaaataatgccagtaattcagctgctacatccaagcactgaagtcttacccgtcaacttttttttttttttaaataaactttatggctgtttgttctacaatgttctagaaattctcactcaggtacacagtgccaacaagtggcttgtgaatgtgttttgttgttttgtgctacaatttttaaaaagaaaaaa

SEQ ID NO: 29982 - DNA, 6969 bp, Homo sapiens
aggatgtcttccaagcgaccagcctctccgtatggggaagcagatggagaggtagccatggtgacaagcagacagaaagtggaagaagaggagagtgacgggctcccagcctttcaccttcccttgcatgtgagttttcccaacaagcctcactctgaggaatttcagccagtttctctgctgacgcaagagacttgtggccataggactcccacttctcagcacaatacaatggaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacgagccggaagaaacccccagtattgaaaaactactctcaaaggactggaaagacaagcttcttgcaatgggatcggggaactttggcgaaataaaagggactcccgagagcttagctgagaaagaaaggcaactcatgggtatgatcaaccagctgaccagcctccgagagcagctgttggctgcccacgatgagcagaagaaactagctgcctctcagattgagaaacagcgtcagcaaatggagctggccaagcagcaacaagaacaaattgcaagacagcagcagcagcttctacagcaacaacacaaaatcaatttgctccagcaacagatccaggttcaaggtcagctgccgccattaatgattcccgtattccctcctgatcaacggacactggctgcagctgcccagcaaggattcctcctccctccaggcttcagctataaggctggatgtagtgacccttaccctgttcagctgatcccaactaccatggcagctgctgccgcagcaacaccaggcttaggcccactccaactgcagcagttatatgctgcccagctagctgcaatgcaggtatctccaggagggaagctgccaggcataccccaaggcaaccttggtgctgctgtatctcctaccagcattcacacagacaagagcacaaacagcccaccacccaaaagcaaggatgaagtggcacagccactgaacctatcagctaaacccaagacctctgatggcaaatcacccacatcacccacctctccccatatgccagctctgagaataaacagtggggcaggccccctcaaagcctctgtcccagcagcgttagctagtccttcagccagagttagcacaataggttacttaaatgaccatgatgctgtcaccaaggcaatccaagaagctcggcaaatgaaggagcaactccgacgggaacaacaggtgcttgatgggaaggtggctgttgtgaatagtctgggtctcaataactgccgaacagaaaaggaaaaaacaacactggagagtctgactcagcaactggcagttaaacagaatgaagaaggaaaatttagccatgcaatgatggatttcaatctgagtggagattctgatggaagtgctggagtctcagagtcaagaatttatagggaatcccgagggcgtggtagcaatgaaccccacataaagcgtccaatgaatgccttcatggtgtgggctaaagatgaacggagaaagatccttcaagcctttcctgacatgcacaactccaacatcagcaagatattgggatctcgctggaaagctatgacaaacctagagaaacagccatattatgaggagcaagcccgtctcagcaagcagcacctggagaagtaccctgactataagtacaagcccaggccaaagcgcacctgcctggtggatggcaaaaagctgcgcattggtgaatacaaggcaatcatgcgcaacaggcggcaggaaatgcggcagtacttcaatgttgggcaacaagcacagatccccattgccactgctggtgttgtgtaccctggagccatcgccatggctgggatgccctcccctcacctgccctcggagcactcaagcgtgtctagcagcccagagcctgggatgcctgttatccagagcacttacggtgtgaaaggagaggagccacatatcaaagaagagatacaggccgaggacatcaatggagaaatttatgatgagtacgacgaggaagaggatgatccagatgtagattatgggagtgacagtgaaaaccatattgcaggacaagccaactgataagggtcaaaagattgttgtgaccttaggacttaaagaagccctaactggttcatccttaccagtggccaagcacattaactttctcatacactgactgttactttaactgttagtcttaaatagttgggacatcagctgactaatagacctcagcctcaaaaggcttggaaagaaaaaacaaatacaacaagcaaacaacaatatcaacaacaagagattgaaataagctatgggtaaaataatgccagtaattcagctgctacatccaagcactgaagtcttacccgtcaacttttttttttttttaaataaactttatggctgtttgttctacaatgttctagaaattctcactcaggtacacagtgccaacaagtggcttgtgaatgtgttttgttgttttgtgctacaatttttaaaaagaaaaaagttttgttttgttttttggggtttctgggttttttccttttctttttctttcctttcattttttttctttgtaatgcacctgacagaaaaaaaagaaaaatgaatttctctttacttctctccaccttctccatctctctactttaaagatggaagtctgtgcatgaggggaaagagggaaaaagagcctgtttttaacttccttgctatccaccacaaaataagcaattattttctttagaggactttatctattgcacaccacactacatctttgagcaagtgccaaatttgtactgaagtgttgaccaagttcattttttctctttactttttccttttccttcttaagttaggacagtgttaaatcttagacaatcccttgaaaaacctgaaataccagcagctggtgagatttgacttttttttttaatggaaactgtaggtgctgttctcaggtgaaaagagagagagagagagagacataagaaatttagagaaaaatattttctgatcttggatttttgtgtgtatgtatgtatgtgattatggtactaataataggaataacgttggaccattgtgagttaaacccacatctggggatgaaatcccacatcctcccaagtgactggtctagaaataatcttgaccttgactttgcacttcaaatgacaacttaaccaagtatagggctcagaaattatatttttaaatgtctgattattattggatggatcaggtggccctgtgtaatagaggtgtgcatgtataacatggaagctactagcaaactgctcccagatgtcctttctccctggtcagttggttccattaacgtttgctacttagtgatttttgtttttcctgttgatattttgagcaaaacaatcattgttttcattgaatatatttggccattttttcagacaaatagaattagcttatttcttcaacattccatcctttcccgatcaggaaatgaaactgatgattttataaggtatttttcacccctccatgaagtgaggtggaggcctttagcatttcagaagtgtgggccatatgtagttcatgccataaaaagtaggatttaattaaaagtcattgcagcccaataaaatggagcctggctgcacccagggatccttgccactgctcttcccttgctgtcagattaatccactgaagtccaactttggttcaagcagagtatttgcaaagagcaacaactgaatgtgatgggactgcttatgtagattttgccagccaaatgccaaggcagttgtagggcctgtacaaataaatgcaaaatcatttcaagtcaattgccattatttgtattgaagtatcagatagatagtaaatactgcaactagtagcttgatgtgctatagttttcactccagtcatcattttcctatctcaccccccgaaacaccaccctaaagttggatttttacatataaataaaaaaagaatcccttttatttttctctctctcagaagacttgctctggggttttgcttggaggagctgatcatatcctgcatgtcagagatttcattttgtttgtttttctgtttgtttgtttttgatgactttatttacatttgaactgcctctttttgctagtgttgtaatgatgatgatgataaaataataataataatagtaataataataataatggtcagctgttcccagattagtaagttatgtataatttattttatttctccctttctattttattctgctctgatttggaagtgcagccaataagctgttagatatttaaaacaaatttccatctccaactcatatatgtatgtatatgtatatatatatatacatatatatacacacatatacacacacacacacacatttacccacaattttacttctctttccgtaagttttctcttttttaagaattttggccccaacaatatcagttctgatgtttaaaacaaaggagtgaattaataggagggtcgtgttcaatcttaattaacttatgctctcatcactcattttagttatttaattgccacagtcatctagagccaatttttttttgtttttgtttgttttgtttttaagcactctggataaggaaaaaatagacacttgtttttatatcatttttatgtacaatgtgaaaacagatttttaaaaaatttgttctctgtctttgttaacaaattccttccgatttatgtgggttcacctctcacgtttgctggatacttactttacaccatgttatgaaagatgctttgttttcatttcatgagtttgggctacaagaatactttgttttagctccaggtagatgccattgaaggcattcatggctgaaatcaattctaacacacttaccgatgaattgacaacactttggtgtttggtcttttttttgttatattttgttttatttgaaggggaaaacaaaattgttaatggtgacttttaactgctgaaattcaaaatttgattttagttaggtttatgtccgagactaaactgtgcatgaaccgaaacaaaaagcaagttcataccgctgcattctgttctcttgttctgacggttaattcactggacatcaaattttctttgccctagttttccccaaaagaaaacaaaagcaaaaatagttatattaatgttgaaagtgctttgaagtcacttgataaaaggtgctatgaatagcaacttactgtgttactacattgcctttttggcattggttgatttataattttggtaaaggatcctaaaaccctgtattctttttctgtgccccataatgaccaaaaaagataaagaaaatgagagtaagatcaaaagatcaaactaaaacataaacagtctccttcctgtctgctttcttacctatctgttcacactttatctctttccctttctctctctctctcacatgcgcgcgcgcgcgcgcgcacacacacacacacacacacttgccccaacactgagaaataatcttgccagaattctggtttttatagttgttgtagtccgtttctctaaaaatagtcctgttttcatatgaatctaagagaacattaccggagaaaataaagttactcatttatagttactaataataagttagtgattaacttaccacaattggataaaatataaaactattcttcagcacatttatacctaaattagtgaagtccatttgtgaagttcatttggcatctgcagttaagagttaaccatgtataaaatccctcccaaagaacataatcatcgttagaaccaaatcctcttataaagaacaaatataaaaaagttttctgtggtgaagctattttatagatttgatttccggagtagaattttaccttaattcacttaaagaaaattaaccattttttggtccaacttcagatattttcttaatccagaagctgtgactgttcccagaagaaacctcttatatcacatttaaaacataaaaaataattacactttcactcattctaatgggtaaattgttgaattgtaataaacaactgtatatttacaaacaggtttataaggtatttgtctatcaaattaataataaaataaaacttacggggtctgcaaggaaaactatgaaggccacttaaagtggttcaggtatccctttgtcttgtagggcatagctgttggtttagccaggcttttacagtatttaattttaaagtatcctataactatcaacttcccaggttgaagacgatgtgttgagtttcctactgattgattgattcctgtcctccccagtgtttccgtcactggttcactaaaacagtatttatatagctccactggctctaaagctcttagtccttctaatattttggattttacaagtaaaaatggaaaaaaaatagaaaagagacaatcaaatgcctggagcttaaaacaaagtatgtgcaacctaccatctcacttgaaatttaataaaataataagtaattatgtaaatataacatagagttatagatttatattttgttcataacacatagtgtaatataagttgtatattttcatgtttttggttttatgttatcattcatgccacaataaaaataaaacaggagtttatgtgctcttaaaaaaaagatgtgggttgccaccaacctgtttttcgtttttgttttttgtttattttattttatttttttgcattctcctttttcagtattactgccatgcaaggcaccaataaaaacagcaaatgtgttctt

SEQ ID NO: 29983 - DNA, 8808 bp, Homo sapiens
ctgttttttttctgcagaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagaagggtcatgtctcccacccacaaattaaccaaaggctaaagggcctaagtgaccgttttggcaggaatttggacacctttgaacatggtggtggccactcttacaaccacaaacagattgagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaattacatcagcagaatggtcttaattgtttcgtaaagtgtgagacagattaagttttccctgatttttcatgaacttgagttttttgttgttattgttattgttgttgttgttgtttttttaatttaggtgaagacatattaaatatgagacaccaggacttgaaacttatctcaacccgtagatgtcttacaagtcttatatttttgtcttactttttttttcttttggatgttgataaaggtttaagttactgttttagatggggttaaacattctcactcaggtatgctgtgccggcctacaggttgtgaatgtgtttttattctgaattattttagaaaacaactgaggatttcatattgtgaaacagaacaagtccacggcgtgtgcagctgcatgtagagcatattcaaaaggcctcggaattccaattttccatttgtagagttaaactttgaatgtgccaaactttttcgtaacttttgaatcttaatattttgaaagtcttaaaggagacactgcaaagtcttagacaatctttggcatcttaaaataaaatagcaaaccaacatttttttttccagaaaatggtaaggtactcaggaatctggagacaagatattgtaaggaatgaacaaggttgccacagtgcatggacccaattgtgtttgcctgttgacgtgccatcagtgcgtgatgtggtatgacatacacacaccagagcaaccgccacaccagatatcgacagagtggtcttctctgcctgagaccacctctcactacatccattatccctttgcctttaaccctgacattcagtcttaacacattttatcttaaataatttattcattccagaatgtcaagggtccacttgctatttattttttttcaattgttggtggcattaatttaataattcttgtttttcaccttccttccccgaagaacttttccgtccttttcacctccttctcctgtgtacatagtgattttatgtccccagaacgcctggaagcatttctgaaaccaagatattattaaaaacctattattgtttttaatcatgagtatgtatctggctgcagggctgtgtattgggatataggtatatagtcttacacttaaacaggtatgcccctgaggttcactgtgacctcaagtcttttgccagaattttcccctaattcagttcacaagtggtagggtctgcatcagtggcatttccccctgaattccattcagcagcaaggttcaacagtggtgactgccaggcaggagagtcctgcggccaaacctgaagcccaaggctcgtgggccatgcaggaatctcagtgaagctgtcatgggctggcacctttacactgagttgccttgtcccagctggcacatctagggagttcattgcaaaatccccaggatgcaaaaagccacatgacagcctcagagcaaagatggtggcaaatagtcatgatacatctagagaatgaaagaaaactgtaagggaggagaaggaggggaatacattccctatatgggatgttcctactgttaactctggggaacagatagctccgggggcagcagatgagttcctctggctgactctatctgtagccacatggggacctgcctacgtgtgaacaaaatgaactgcacttatcacacaaggatttctttgaagacatgctactggggtgggaagcagtgaggttttattccccatctcctaactacagggagctctgccatgtcattttggccttcctgaaactaggacaggttgtctatcggggggcttcccccagagaggtttagtgggagaatgtcagtgaatgggatagttcacctcatgggacaacccagaatctgatcaccaggacataggaatggccccatcagatttcttgagccattttgtcacttggaagaaaatagtgtacctttgtatttatttaagagtgctcaaggcctaatagcaataaacaggtctagccaagaaattacaagctattctgttagctgggagtgctctctataagctgattaaggtactgataggaactctttgttattcatgttggttggggattagaaatttgtttttgtacatttatttcaaatgaggaggaggtcattttttctctcaaaaaatgagtatttattattgtcttactgatttctttgattatatacctctcctcctcagttcactcttgttttttttctttctctttggcttttgcttttgctctctctcacttctttcttattttgttgcattggtagagtgttgtatggctagcattgtattgtatgtaattaattttgcacaaaagcaaacatttagcatagtaggttaattttgtttgtttttatgaccatgccaaaataatattctgggctggtggagaacaaaggactgttctttaggactgaaacttgattttgctcatagtaagtaaaaaaaaacaaaaaacacacacactcacagatgttgtttcgtaagtgttataagcactggatataaatggtattttttatcacttctgactaatgtgaaactgttgtacgaaaactacatgaacaaaagtcatctgtttcgactcgtgtgggcttgcctcacagttgccggatttgagtcatttttatgtcttgttatttcatttatttatgcaaaatacatgtgtgtatgaacactttgttttagctccagctctgcctcagtactggggttcatttacttttagccatgttcttaaaaatgaaaggctattcaggaatgatctgattgtaaacgtctttttcattggatcaaacagtaatgctgtatttgaatctaaattttgtgtataagcagtttatttattagccaagtttggctctaaatatccatggaaattaagaatgacaatcatagggatcaattcattttattttcagtggggcttaaacaaagtttatatgactttaccatctcattttagatttttctaattgtgtaaatataacatagaaatagaatttatttttggttcatgaatacttagtgagatataagttatgtatttcctttttgttctctatccatagatgttggtccaaactgaaagttgatgagtcactgtgcctctcggggtagtgagttatcagctacagtgagagagcagtgtttggcctgcagctgggacagcaaaacgtttcaccagggttctcatgcagttcagaacccactgtccacagatccagacatttcccttttttcttacagaaagttgatgattggacatactaaatttccactacagttaggagacagtcagtttgctttgggagtctacataaatcttctaagatagttctgtgaccatttaatagcaagaagcatgaatgccactacaaaggcaaaaatccacctctgagatcggccgttaataaacgtcccgtcatgtcagtttagattcaagaatgttaagcaactttgtttttgcggtgctccctatttcatagtatcttcaaatcaaaaataaaaattatctccattttgttaaagaacttacagggtcagggttctccttgtcacttagaattgggacactgccaggcaatcctctcccaaaaaaaaaaaaaaaaaaaaatagccatatggaatggaaggaaaaggagaaaagaaggaagaaaggaaaaaagtaggaagggagagagaaaaaaaaggtcgctttgcggatacgagccgctaggctgacaacttttctatttcattggcagatatgaagcagtgtcttttccagtaaggtacggaagctttgttgttttcatgtgtacccagctcagccttttagaagcacctcggtttgcttcattaggtatttgatactctccagccttgtcctcaggcctgatttgatttgccagggtcctgacaccaaagcccaggccaagttctaaattcaggtgtgggctcacagtgctattgagcttgtcgaattctggcctcccctgaacattagccccacgggagcctgagggtgtttgaaaagggcgtgatcactctagggctgaaattaaaggctgctttcttttccttctgaagccaggctgcttcttcggagtacaccctcctgagccaggagcacaagcactagcagaaagcagggattgtttcaggaaagcccatttaccctcagtaggaaggcagcctggtcacttgaacagcacagctgaggctgcttctctcaatttactcattttgcaaagaattgacctctaccaactcattagggagaggaaaaagaatcacttagtaattttaaatcatatgagaagtcctgtaccaagtgccaacaactgcaaagaaatgcagctagaggaatgtattgaaattactactgggtcttcctttttaatgagaaaatgacaaaaatggttgctgtagccctgcctgattttgtacacgtttgtctaagaattgagttggcacttaagctcacttctcaaagtataataatattgtatgacctcatttgtcctttcacaaaagcacttgcatcatttccttaagtcatctgctccctgacatgttttcttccctaataaacaacttctgtctgttattcctgccaatgatgttctgtttctgatgccatatcctattgagcgtgcccctgtactaatatcattgaaaatattgatatgcaaacacatttccttttcatccccattctatctttccctttggggacagattgctttccaaaagctcatgaacaaatatttggaatgctggtacctttggggcagaggtaagggtgggcggggtgggggcagaaaggtaatgcttaatgcagataactcttctaatcagtgtccatggcaatatgaacgcttgaagaaaactcagtgacatatcttgctcagtagtttcttattcctgaagaaccacaagcataaagtgaggcctcagtgctggtgctcttggagtatggggaatgtgcaaatatttaactgttttgtatgctgcacattgcaggtctgctcatgtgcattctccctttgtcttcctttgtcatatgtgtttttgcttttttgaaagtgcagtctttattgtaccctcctccagcttgtagcaaattagaatgcttagcatttatgttcattcattattgtatttgccatgtaaaatttttattaccttagacaagcttataagctgttactacataacttatcttactgtaactcttttatttcccccgacgttgtaatttgtttgtgatgtatattgtgaaattgtattctatgttaatttaatcagcacaattcactgacatgctggactgacatgctggctgctgtttcaaagtgtaaagtttgtgtagggctgttgggacaactgcaactctgttgtcaaggtactgtgctttggttcctatagcaacactgggtgtggcccttgaattgctaagggcatttaatacatcctggagcaaattttaactgcagattttctttgtagaaattctatgtataatgcaggtacctacttggcccatggctggtaactatttgggcaattagaaaaaaagaaaaaaacataaaaactagtgtctattgctgctttgaatatgtttgaaagtctgaaaatgtaaatagtttatcaaaaaaaaatcttgtacagtccagtgtaaagtttttaaatgaccttaagggttgccatcacatctttctcacactctcctcttgataataataataataaaaagtttgctaaggattaaagaaatgggaaaaataaaaaaaatctcttcaaatttacaggaatgaatcattgttcttagctttgttgcatacacaaacttcttggattttgttgtgcagtattgacgtgagataaagctcaacattgaataatctttcagtggtacttttcaaagtcttcccctcctctgcctcataattaagggaaaagacaaaattgaaagacacactgtctttatctatcctggtgtatgttggcaccttagctactttttttttttcctttttgcacaaggtgctttcctgatatgttcaacatgccatctttgggtgataatgtatatgccgtgatggggctcaggccccttaggggagtgtctataagaactgcctatttatgctcatttacctcaagactgtcctctctaccctaatctagttgtcatcactccatcttttgtactgctgttgacacttacaaattaaagataaattttgttttatga

SEQ ID NO: 29984 - DNA, 8925 bp, Homo sapiens
gtcactttcatgaattcaaaggcaatttaccagtgatttctgggtgctggggctgatattttttgtgcatatttaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagaagggtcatgtctcccacccacaaattaaccaaaggctaaagggcctaagtgaccgttttggcaggaatttggacacctttgaacatggtggtggccactcttacaaccacaaacagattgagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaagtaaagcaatgaatggctctgcagctaaactacagcagtattattgttggccaacaggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaattacatcagcagaatggtcttaattgtttcgtaaagtgtgagacagattaagttttccctgatttttcatgaacttgagttttttgttgttattgttattgttgttgttgttgtttttttaatttaggtgaagacatattaaatatgagacaccaggacttgaaacttatctcaacccgtagatgtcttacaagtcttatatttttgtcttactttttttttcttttggatgttgataaaggtttaagttactgttttagatggggttaaacattctcactcaggtatgctgtgccggcctacaggttgtgaatgtgtttttattctgaattattttagaaaacaactgaggatttcatattgtgaaacagaacaagtccacggcgtgtgcagctgcatgtagagcatattcaaaaggcctcggaattccaattttccatttgtagagttaaactttgaatgtgccaaactttttcgtaacttttgaatcttaatattttgaaagtcttaaaggagacactgcaaagtcttagacaatctttggcatcttaaaataaaatagcaaaccaacatttttttttccagaaaatggtaaggtactcaggaatctggagacaagatattgtaaggaatgaacaaggttgccacagtgcatggacccaattgtgtttgcctgttgacgtgccatcagtgcgtgatgtggtatgacatacacacaccagagcaaccgccacaccagatatcgacagagtggtcttctctgcctgagaccacctctcactacatccattatccctttgcctttaaccctgacattcagtcttaacacattttatcttaaataatttattcattccagaatgtcaagggtccacttgctatttattttttttcaattgttggtggcattaatttaataattcttgtttttcaccttccttccccgaagaacttttccgtccttttcacctccttctcctgtgtacatagtgattttatgtccccagaacgcctggaagcatttctgaaaccaagatattattaaaaacctattattgtttttaatcatgagtatgtatctggctgcagggctgtgtattgggatataggtatatagtcttacacttaaacaggtatgcccctgaggttcactgtgacctcaagtcttttgccagaattttcccctaattcagttcacaagtggtagggtctgcatcagtggcatttccccctgaattccattcagcagcaaggttcaacagtggtgactgccaggcaggagagtcctgcggccaaacctgaagcccaaggctcgtgggccatgcaggaatctcagtgaagctgtcatgggctggcacctttacactgagttgccttgtcccagctggcacatctagggagttcattgcaaaatccccaggatgcaaaaagccacatgacagcctcagagcaaagatggtggcaaatagtcatgatacatctagagaatgaaagaaaactgtaagggaggagaaggaggggaatacattccctatatgggatgttcctactgttaactctggggaacagatagctccgggggcagcagatgagttcctctggctgactctatctgtagccacatggggacctgcctacgtgtgaacaaaatgaactgcacttatcacacaaggatttctttgaagacatgctactggggtgggaagcagtgaggttttattccccatctcctaactacagggagctctgccatgtcattttggccttcctgaaactaggacaggttgtctatcggggggcttcccccagagaggtttagtgggagaatgtcagtgaatgggatagttcacctcatgggacaacccagaatctgatcaccaggacataggaatggccccatcagatttcttgagccattttgtcacttggaagaaaatagtgtacctttgtatttatttaagagtgctcaaggcctaatagcaataaacaggtctagccaagaaattacaagctattctgttagctgggagtgctctctataagctgattaaggtactgataggaactctttgttattcatgttggttggggattagaaatttgtttttgtacatttatttcaaatgaggaggaggtcattttttctctcaaaaaatgagtatttattattgtcttactgatttctttgattatatacctctcctcctcagttcactcttgttttttttctttctctttggcttttgcttttgctctctctcacttctttcttattttgttgcattggtagagtgttgtatggctagcattgtattgtatgtaattaattttgcacaaaagcaaacatttagcatagtaggttaattttgtttgtttttatgaccatgccaaaataatattctgggctggtggagaacaaaggactgttctttaggactgaaacttgattttgctcatagtaagtaaaaaaaaacaaaaaacacacacactcacagatgttgtttcgtaagtgttataagcactggatataaatggtattttttatcacttctgactaatgtgaaactgttgtacgaaaactacatgaacaaaagtcatctgtttcgactcgtgtgggcttgcctcacagttgccggatttgagtcatttttatgtcttgttatttcatttatttatgcaaaatacatgtgtgtatgaacactttgttttagctccagctctgcctcagtactggggttcatttacttttagccatgttcttaaaaatgaaaggctattcaggaatgatctgattgtaaacgtctttttcattggatcaaacagtaatgctgtatttgaatctaaattttgtgtataagcagtttatttattagccaagtttggctctaaatatccatggaaattaagaatgacaatcatagggatcaattcattttattttcagtggggcttaaacaaagtttatatgactttaccatctcattttagatttttctaattgtgtaaatataacatagaaatagaatttatttttggttcatgaatacttagtgagatataagttatgtatttcctttttgttctctatccatagatgttggtccaaactgaaagttgatgagtcactgtgcctctcggggtagtgagttatcagctacagtgagagagcagtgtttggcctgcagctgggacagcaaaacgtttcaccagggttctcatgcagttcagaacccactgtccacagatccagacatttcccttttttcttacagaaagttgatgattggacatactaaatttccactacagttaggagacagtcagtttgctttgggagtctacataaatcttctaagatagttctgtgaccatttaatagcaagaagcatgaatgccactacaaaggcaaaaatccacctctgagatcggccgttaataaacgtcccgtcatgtcagtttagattcaagaatgttaagcaactttgtttttgcggtgctccctatttcatagtatcttcaaatcaaaaataaaaattatctccattttgttaaagaacttacagggtcagggttctccttgtcacttagaattgggacactgccaggcaatcctctcccaaaaaaaaaaaaaaaaaaaaatagccatatggaatggaaggaaaaggagaaaagaaggaagaaaggaaaaaagtaggaagggagagagaaaaaaaaggtcgctttgcggatacgagccgctaggctgacaacttttctatttcattggcagatatgaagcagtgtcttttccagtaaggtacggaagctttgttgttttcatgtgtacccagctcagccttttagaagcacctcggtttgcttcattaggtatttgatactctccagccttgtcctcaggcctgatttgatttgccagggtcctgacaccaaagcccaggccaagttctaaattcaggtgtgggctcacagtgctattgagcttgtcgaattctggcctcccctgaacattagccccacgggagcctgagggtgtttgaaaagggcgtgatcactctagggctgaaattaaaggctgctttcttttccttctgaagccaggctgcttcttcggagtacaccctcctgagccaggagcacaagcactagcagaaagcagggattgtttcaggaaagcccatttaccctcagtaggaaggcagcctggtcacttgaacagcacagctgaggctgcttctctcaatttactcattttgcaaagaattgacctctaccaactcattagggagaggaaaaagaatcacttagtaattttaaatcatatgagaagtcctgtaccaagtgccaacaactgcaaagaaatgcagctagaggaatgtattgaaattactactgggtcttcctttttaatgagaaaatgacaaaaatggttgctgtagccctgcctgattttgtacacgtttgtctaagaattgagttggcacttaagctcacttctcaaagtataataatattgtatgacctcatttgtcctttcacaaaagcacttgcatcatttccttaagtcatctgctccctgacatgttttcttccctaataaacaacttctgtctgttattcctgccaatgatgttctgtttctgatgccatatcctattgagcgtgcccctgtactaatatcattgaaaatattgatatgcaaacacatttccttttcatccccattctatctttccctttggggacagattgctttccaaaagctcatgaacaaatatttggaatgctggtacctttggggcagaggtaagggtgggcggggtgggggcagaaaggtaatgcttaatgcagataactcttctaatcagtgtccatggcaatatgaacgcttgaagaaaactcagtgacatatcttgctcagtagtttcttattcctgaagaaccacaagcataaagtgaggcctcagtgctggtgctcttggagtatggggaatgtgcaaatatttaactgttttgtatgctgcacattgcaggtctgctcatgtgcattctccctttgtcttcctttgtcatatgtgtttttgcttttttgaaagtgcagtctttattgtaccctcctccagcttgtagcaaattagaatgcttagcatttatgttcattcattattgtatttgccatgtaaaatttttattaccttagacaagcttataagctgttactacataacttatcttactgtaactcttttatttcccccgacgttgtaatttgtttgtgatgtatattgtgaaattgtattctatgttaatttaatcagcacaattcactgacatgctggactgacatgctggctgctgtttcaaagtgtaaagtttgtgtagggctgttgggacaactgcaactctgttgtcaaggtactgtgctttggttcctatagcaacactgggtgtggcccttgaattgctaagggcatttaatacatcctggagcaaattttaactgcagattttctttgtagaaattctatgtataatgcaggtacctacttggcccatggctggtaactatttgggcaattagaaaaaaagaaaaaaacataaaaactagtgtctattgctgctttgaatatgtttgaaagtctgaaaatgtaaatagtttatcaaaaaaaaatcttgtacagtccagtgtaaagtttttaaatgaccttaagggttgccatcacatctttctcacactctcctcttgataataataataataaaaagtttgctaaggattaaagaaatgggaaaaataaaaaaaatctcttcaaatttacaggaatgaatcattgttcttagctttgttgcatacacaaacttcttggattttgttgtgcagtattgacgtgagataaagctcaacattgaataatctttcagtggtacttttcaaagtcttcccctcctctgcctcataattaagggaaaagacaaaattgaaagacacactgtctttatctatcctggtgtatgttggcaccttagctactttttttttttcctttttgcacaaggtgctttcctgatatgttcaacatgccatctttgggtgataatgtatatgccgtgatggggctcaggccccttaggggagtgtctataagaactgcctatttatgctcatttacctcaagactgtcctctctaccctaatctagttgtcatcactccatcttttgtactgctgttgacacttacaaattaaagataaattttgttttatga

SEQ ID NO: 29985 - DNA, 8865 bp, Homo sapiens
gtcactttcatgaattcaaaggcaatttaccagtgatttctgggtgctggggctgatattttttgtgcatatttaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagaagggtcatgtctcccacccacaaattaaccaaaggctaaagggcctaagtgaccgttttggcaggaatttggacacctttgaacatggtggtggccactcttacaaccacaaacagattgagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaattacatcagcagaatggtcttaattgtttcgtaaagtgtgagacagattaagttttccctgatttttcatgaacttgagttttttgttgttattgttattgttgttgttgttgtttttttaatttaggtgaagacatattaaatatgagacaccaggacttgaaacttatctcaacccgtagatgtcttacaagtcttatatttttgtcttactttttttttcttttggatgttgataaaggtttaagttactgttttagatggggttaaacattctcactcaggtatgctgtgccggcctacaggttgtgaatgtgtttttattctgaattattttagaaaacaactgaggatttcatattgtgaaacagaacaagtccacggcgtgtgcagctgcatgtagagcatattcaaaaggcctcggaattccaattttccatttgtagagttaaactttgaatgtgccaaactttttcgtaacttttgaatcttaatattttgaaagtcttaaaggagacactgcaaagtcttagacaatctttggcatcttaaaataaaatagcaaaccaacatttttttttccagaaaatggtaaggtactcaggaatctggagacaagatattgtaaggaatgaacaaggttgccacagtgcatggacccaattgtgtttgcctgttgacgtgccatcagtgcgtgatgtggtatgacatacacacaccagagcaaccgccacaccagatatcgacagagtggtcttctctgcctgagaccacctctcactacatccattatccctttgcctttaaccctgacattcagtcttaacacattttatcttaaataatttattcattccagaatgtcaagggtccacttgctatttattttttttcaattgttggtggcattaatttaataattcttgtttttcaccttccttccccgaagaacttttccgtccttttcacctccttctcctgtgtacatagtgattttatgtccccagaacgcctggaagcatttctgaaaccaagatattattaaaaacctattattgtttttaatcatgagtatgtatctggctgcagggctgtgtattgggatataggtatatagtcttacacttaaacaggtatgcccctgaggttcactgtgacctcaagtcttttgccagaattttcccctaattcagttcacaagtggtagggtctgcatcagtggcatttccccctgaattccattcagcagcaaggttcaacagtggtgactgccaggcaggagagtcctgcggccaaacctgaagcccaaggctcgtgggccatgcaggaatctcagtgaagctgtcatgggctggcacctttacactgagttgccttgtcccagctggcacatctagggagttcattgcaaaatccccaggatgcaaaaagccacatgacagcctcagagcaaagatggtggcaaatagtcatgatacatctagagaatgaaagaaaactgtaagggaggagaaggaggggaatacattccctatatgggatgttcctactgttaactctggggaacagatagctccgggggcagcagatgagttcctctggctgactctatctgtagccacatggggacctgcctacgtgtgaacaaaatgaactgcacttatcacacaaggatttctttgaagacatgctactggggtgggaagcagtgaggttttattccccatctcctaactacagggagctctgccatgtcattttggccttcctgaaactaggacaggttgtctatcggggggcttcccccagagaggtttagtgggagaatgtcagtgaatgggatagttcacctcatgggacaacccagaatctgatcaccaggacataggaatggccccatcagatttcttgagccattttgtcacttggaagaaaatagtgtacctttgtatttatttaagagtgctcaaggcctaatagcaataaacaggtctagccaagaaattacaagctattctgttagctgggagtgctctctataagctgattaaggtactgataggaactctttgttattcatgttggttggggattagaaatttgtttttgtacatttatttcaaatgaggaggaggtcattttttctctcaaaaaatgagtatttattattgtcttactgatttctttgattatatacctctcctcctcagttcactcttgttttttttctttctctttggcttttgcttttgctctctctcacttctttcttattttgttgcattggtagagtgttgtatggctagcattgtattgtatgtaattaattttgcacaaaagcaaacatttagcatagtaggttaattttgtttgtttttatgaccatgccaaaataatattctgggctggtggagaacaaaggactgttctttaggactgaaacttgattttgctcatagtaagtaaaaaaaaacaaaaaacacacacactcacagatgttgtttcgtaagtgttataagcactggatataaatggtattttttatcacttctgactaatgtgaaactgttgtacgaaaactacatgaacaaaagtcatctgtttcgactcgtgtgggcttgcctcacagttgccggatttgagtcatttttatgtcttgttatttcatttatttatgcaaaatacatgtgtgtatgaacactttgttttagctccagctctgcctcagtactggggttcatttacttttagccatgttcttaaaaatgaaaggctattcaggaatgatctgattgtaaacgtctttttcattggatcaaacagtaatgctgtatttgaatctaaattttgtgtataagcagtttatttattagccaagtttggctctaaatatccatggaaattaagaatgacaatcatagggatcaattcattttattttcagtggggcttaaacaaagtttatatgactttaccatctcattttagatttttctaattgtgtaaatataacatagaaatagaatttatttttggttcatgaatacttagtgagatataagttatgtatttcctttttgttctctatccatagatgttggtccaaactgaaagttgatgagtcactgtgcctctcggggtagtgagttatcagctacagtgagagagcagtgtttggcctgcagctgggacagcaaaacgtttcaccagggttctcatgcagttcagaacccactgtccacagatccagacatttcccttttttcttacagaaagttgatgattggacatactaaatttccactacagttaggagacagtcagtttgctttgggagtctacataaatcttctaagatagttctgtgaccatttaatagcaagaagcatgaatgccactacaaaggcaaaaatccacctctgagatcggccgttaataaacgtcccgtcatgtcagtttagattcaagaatgttaagcaactttgtttttgcggtgctccctatttcatagtatcttcaaatcaaaaataaaaattatctccattttgttaaagaacttacagggtcagggttctccttgtcacttagaattgggacactgccaggcaatcctctcccaaaaaaaaaaaaaaaaaaaaatagccatatggaatggaaggaaaaggagaaaagaaggaagaaaggaaaaaagtaggaagggagagagaaaaaaaaggtcgctttgcggatacgagccgctaggctgacaacttttctatttcattggcagatatgaagcagtgtcttttccagtaaggtacggaagctttgttgttttcatgtgtacccagctcagccttttagaagcacctcggtttgcttcattaggtatttgatactctccagccttgtcctcaggcctgatttgatttgccagggtcctgacaccaaagcccaggccaagttctaaattcaggtgtgggctcacagtgctattgagcttgtcgaattctggcctcccctgaacattagccccacgggagcctgagggtgtttgaaaagggcgtgatcactctagggctgaaattaaaggctgctttcttttccttctgaagccaggctgcttcttcggagtacaccctcctgagccaggagcacaagcactagcagaaagcagggattgtttcaggaaagcccatttaccctcagtaggaaggcagcctggtcacttgaacagcacagctgaggctgcttctctcaatttactcattttgcaaagaattgacctctaccaactcattagggagaggaaaaagaatcacttagtaattttaaatcatatgagaagtcctgtaccaagtgccaacaactgcaaagaaatgcagctagaggaatgtattgaaattactactgggtcttcctttttaatgagaaaatgacaaaaatggttgctgtagccctgcctgattttgtacacgtttgtctaagaattgagttggcacttaagctcacttctcaaagtataataatattgtatgacctcatttgtcctttcacaaaagcacttgcatcatttccttaagtcatctgctccctgacatgttttcttccctaataaacaacttctgtctgttattcctgccaatgatgttctgtttctgatgccatatcctattgagcgtgcccctgtactaatatcattgaaaatattgatatgcaaacacatttccttttcatccccattctatctttccctttggggacagattgctttccaaaagctcatgaacaaatatttggaatgctggtacctttggggcagaggtaagggtgggcggggtgggggcagaaaggtaatgcttaatgcagataactcttctaatcagtgtccatggcaatatgaacgcttgaagaaaactcagtgacatatcttgctcagtagtttcttattcctgaagaaccacaagcataaagtgaggcctcagtgctggtgctcttggagtatggggaatgtgcaaatatttaactgttttgtatgctgcacattgcaggtctgctcatgtgcattctccctttgtcttcctttgtcatatgtgtttttgcttttttgaaagtgcagtctttattgtaccctcctccagcttgtagcaaattagaatgcttagcatttatgttcattcattattgtatttgccatgtaaaatttttattaccttagacaagcttataagctgttactacataacttatcttactgtaactcttttatttcccccgacgttgtaatttgtttgtgatgtatattgtgaaattgtattctatgttaatttaatcagcacaattcactgacatgctggactgacatgctggctgctgtttcaaagtgtaaagtttgtgtagggctgttgggacaactgcaactctgttgtcaaggtactgtgctttggttcctatagcaacactgggtgtggcccttgaattgctaagggcatttaatacatcctggagcaaattttaactgcagattttctttgtagaaattctatgtataatgcaggtacctacttggcccatggctggtaactatttgggcaattagaaaaaaagaaaaaaacataaaaactagtgtctattgctgctttgaatatgtttgaaagtctgaaaatgtaaatagtttatcaaaaaaaaatcttgtacagtccagtgtaaagtttttaaatgaccttaagggttgccatcacatctttctcacactctcctcttgataataataataataaaaagtttgctaaggattaaagaaatgggaaaaataaaaaaaatctcttcaaatttacaggaatgaatcattgttcttagctttgttgcatacacaaacttcttggattttgttgtgcagtattgacgtgagataaagctcaacattgaataatctttcagtggtacttttcaaagtcttcccctcctctgcctcataattaagggaaaagacaaaattgaaagacacactgtctttatctatcctggtgtatgttggcaccttagctactttttttttttcctttttgcacaaggtgctttcctgatatgttcaacatgccatctttgggtgataatgtatatgccgtgatggggctcaggccccttaggggagtgtctataagaactgcctatttatgctcatttacctcaagactgtcctctctaccctaatctagttgtcatcactccatcttttgtactgctgttgacacttacaaattaaagataaattttgttttatga

SEQ ID NO: 29986 - DNA, 534 bp, Homo sapiens
gtggaggtagaggatgatttcaattagaaataatgacagcaatagacgcttccaatgaagatatcgtggccaccaaaggacaaaggcaagaagttaattcctgaagtcgagaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttga

SEQ ID NO: 29987 - DNA, 2707 bp, Homo sapiens
ccttggggttagttttagtcatatttttatctctataaaacatcaggctgggaggtggtgtgtgcctgtagtctcaactgctagggagcctgaggcaggaagactccttgagcacaggagttcaaggccagcctgtgcaacatagtgagaccctatcactctggaaaaaaaaaaaaaatctgcggagaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttaggtaaatggaaaagtcaacaccaggaagagacttacgaattagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaagtaaagcaatgaatggctctgcagctaaactacagcagtattattgttggccaacaggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaattacatcagcagaa

SEQ ID NO: 29988 - DNA, 2656 bp, Homo sapiens
gttaggagagaccattggggataggaaagatgaaaggtcatggtgagcttcaaggacatgaaagaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagaagggtcatgtctcccacccacaaattaaccaaaggctaaagggcctaagtgaccgttttggcaggaatttggacacctttgaacatggtggtggccactcttacaaccacaaacagattgagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaagtaaagcaatgaatggctctgcagctaaactacagcagtattattgttggccaacaggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaattaca

SEQ ID NO: 29989 - DNA, 549 bp, Homo sapiens
aaagaaagagcaagccccataatggcagcatctttatcttgcacactagtctgtctcttgtgcctgtaacaatgccaggaactttagtaactatttttttttgaattttgacaatcttggtcgacaagggtaaaaaaggacattccagaagcagaaaaacatgagcaaaagtatggagacatcaaaggtcatggcatatgttcgtttatcatggctggaatgaggggtatgaggaagatgactgagagtgtgtactttggagtcagtcagagcagagttgacttcattttatgctacctttatgattaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatgg

SEQ ID NO: 29990 - DNA, 586 bp, Homo sapiens
gattattaatccagctagagaagaaatatgcttttacttagcaagaatgagtatccaaagagctgataatattgttaaggcagcggggtggaatggcagagcttgaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaa

SEQ ID NO: 29991 - DNA, 2699 bp, Homo sapiens
gggataggaaagatgaaaggtcatggtgagcttcaaggacatgaaaggttgttgtctcatgtaacaatagtagattgttttttttcctaatatttctagccagcccctaagtcaggtgatggaacaaatacctacagtttagtcaggtgaaacaggagtgggtggaggaaggaaagaagaaaaatgggaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttaggtaaatggaaaagtcaacaccaggaagagacttacgaattagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaagtaaagcaatgaatggctctgcagctaaactacagcagtattattgttggccaacaggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaattaca

SEQ ID NO: 29992 - DNA, 3216 bp, Homo sapiens
aagttggacgccccgacccgtgcgagggccaggtccgcgcctgccccgccaggcgaagcgaggcgacccgcgtgcggccatggcttcgctgctgggagcctacccttggcccgagggtctcgagtgcccggccctggacgccgagctgtcggatggacaatcgccgccggccgtcccccggcccccgggggacaagggctccgagagccgtatccggcggcccatgaacgccttcatggtttgggccaaggacgagaggaaacggctggcagtgcagaacccggacctgcacaacgccgagctcagcaagatgctgggaaagtcgtggaaggcgctgacgctgtcccagaagaggccgtacgtggacgaggcggagcggctgcgcctgcagcacatgcaggactaccccaactacaagtaccggccgcgcaggaagaagcaggccaagcggctgtgcaagcgcgtggacccgggcttccttctgagctccctctcccgggaccagaacgccctgccggagaagagaagcggcagccggggggcgctgggggagaaggaggacaggggtgagtactcccccggcactgccctgcccagcctccggggctgctaccacgaggggccggctggtggtggcggcggcggcaccccgagcagtgtggacacgtacccgtacgggctgcccacacctcctgaaatgtctcccctggacgtgctggagccggagcagaccttcttctcctccccctgccaggaggagcatggccatccccgccgcatcccccacctgccagggcacccgtactcaccggagtacgccccaagccctctccactgtagccaccccctgggctccctggcccttggccagtcccccggcgtctccatgatgtcccctgtacccggctgtcccccatctcctgcctattactccccggccacctaccacccactccactccaacctccaagcccacctgggccagctttccccgcctcctgagcaccctggcttcgacgccctggatcaactgagccaggtggaactcctgggggacatggatcgcaatgaattcgaccagtatttgaacactcctggccacccagactccgccacaggggccatggccctcagtgggcatgttccggtctcccaggtgacaccaacgggtcccacagagaccagcctcatctccgtcctggctgatgccacggccacgtactacaacagctacagtgtgtcatagagctggaggcgccccgtccggtcagccctcgcgccctctccttcttgtgccttgagtggcagaggagccgtccagccacaccagctttcctcccaccgctcagggcagggaggtctgaactgcggccccagagcctttggcctaagctggactctccttatccgagtgccgcctctatccccttccccacgttccagcccctgcagcccacattttaagtatattccttcaagtgagttttcctccagcccctgagagttgctgtctcccagtggaatgttcactgacgtcttttcttggtagccatcatcgaaactaatggggggacagacttgatagccaaggtcccttctggtccagttttctgatttagggttctctcaagattaataaaggaagatggggaaatttgactcattaatgagctcgctaacctacgatctggtgataattttgtgtgcacagcccaaggaccacgaggctttctgcactttctgcacccccttccaaagtgaccacaaaatttcaaagggactcatacaatttgagaaaaaacagtcaacctgatttgagaaattaaccagtatggctaactatatcacagaaaatgggattgagttaaaactattttattttaaatatacattttaaagcagttctttttttttgttaatttgtttattatacacacacttcaagagaatatgcacagtctaggccgggcacggtggctcacgcctgtaatcccagcactttgggaggccgaggcatgtggatcacctgaggtcaggagtttgagaccagcctagacaacatggtgaaaccttgtctctatgaaaaatacaaaatttgctgggagtggtggtgcatgcctgtaatcccagctacttggaaggctgaggcaggagaatgtcttgaacctaggaggtggaggttgcagtgagctgagattgcaccattgcactccagcctgtgcaacaagagtgaaactccatttcaagaaaaaaaaaaaaaaaagaatatgcacagtctgaatgtataccaggagtgtgagagacacatgcccacttcatgcaactcctaaactcaaagtctaaatcagatatttttattaacaatgacaacttgttgccaactccctgtttctaatgaccaaagacccagggtacctaaaaggactttgcaaccaagcaaagtcactgtcttcaaatctggatacacactttcccctctgtagattcaaaaggtgcttccttcccggctgtctccagcttccttactctcttttctgggatttctttttctcttctttctgctcttcctccactgctgaactggtccctaactgaaacagcccctgacttatcccaagcatgcttcctttagctgctgtgagaatttgtcttcctcaccagccaggtcctcaggcaaagtcctcagccagtgctttagagcaacttcccgcaaatcagaaactcactgtgattccaaaaatgtttctgagccctggacccctgcccccaaaatattttcatctttcccccaaacctcctttaaaggagcatgcataacagtgtgctgaaagacagttgttggttttttgattttagcatattatttcctgtatgaaatatgttttatataatctcctattatttttatcttatgttttgtattgttgataaatcctttttgtccttctaagatgtcctattgtaaaatcacttataaggtatgattactctttatgctattactttatatgccatttggtaataaatagtaaattgttgatgatatgattgactgatgcgcagtccagagcatgtatgaataatctcataaaacagtatcacagacattaagctaaactgtttcgtttttttgaaagaacaactcatactttggaacagttgtcaatattaatttgttgcaaatatttaatttaaataaacatttttgtaccatga

SEQ ID NO: 29993 - DNA, 1753 bp, Homo sapiens
tacgcacgtcctgattctcctggagtctccagcccgcccagtggccgcagtcacccaggtccagaggcggcggtatcacaggctctccgacatgtctatgctggctgaacgtcggcggaagcagaagtgggctgtggatcctcagaacactgcctggagtaatgacgattccaagtttggccagcggatgctagagaagatggggtggtctaaaggaaagggtttaggggctcaggagcaaggagccacagatcatattaaagttcaagtgaaaaataaccacctgggactcggagctaccatcaataatgaagacaactggattgcccatcaggatgattttaaccagcttctggccgaactgaacacttgccatgggcaggaaaccacagattcctcggacaagaaggaaaagaaatcttttagccttgaggaaaagtccaaaatctccaaaaaccgtgttcactatatgaaattcacaaaaggaaagtcgtggaaggcgctgacgctgtcccagaagaggccgtacgtggacgaggcggagcggctgcgcctgcagcacatgcaggactaccccaactacaagtaccggccgcgcaggaagaagcaggccaagcggctgtgcaagcgcgtggacccgggcttccttctgagctccctctcccgggaccagaacgccctgccggagaagagaagcggcagccggggggcgctgggggagaaggaggacaggggtgagtactcccccggcactgccctgcccagcctccggggctgctaccacgaggggccggctggtggtggcggcggcggcaccccgagcagtgtggacacgtacccgtacgggctgcccacacctcctgaaatgtctcccctggacgtgctggagccggagcagaccttcttctcctccccctgccaggaggagcatggccatccccgccgcatcccccacctgccagggcacccgtactcaccggagtacgccccaagccctctccactgtagccaccccctgggctccctggcccttggccagtcccccggcgtctccatgatgtcccctgtacccggctgtcccccatctcctgcctattactccccggccacctaccacccactccactccaacctccaagcccacctgggccagctttccccgcctcctgagcaccctggcttcgacgccctggatcaactgagccaggtggaactcctgggggacatggatcgcaatgaattcgaccagtatttgaacactcctggccacccagactccgccacaggggccatggccctcagtgggcatgttccggtctcccaggtgacaccaacgggtcccacagagaccagcctcatctccgtcctggctgatgccacggccacgtactacaacagctacagtgtgtcatagagctggaggcgccccgtccggtcagccctcgcgccctctccttcttgtgccttgagtggcagaggagccgtccagccacaccagctttcctcccaccgctcagggcagggaggtctgaactgcggccccagagcctttggcctaagctggactctccttatccgagtgccgcctctatccccttccccacgttccagcccctgcagcccacattttaagtatattccttcaagtgagttttcctccagcccctgagagttgctgtctcccagtggaatgttcactgacgtcttttcttggtagccatcatcgaaactaatggggggacagacttgatag

SEQ ID NO: 29994 - DNA, 3049 bp, Homo sapiens
ggcgagggtcggggccaccgcgcggcgacctcgggtcccggagcgaccgcagggcagccccgggcgccggccccggtgcgcgtctcctgtgcgcgcccctccgcgcgcggccccgatgctggacatgagcgaggcccgctcccagccgccctgcagcccgtccggcaccgccagctccatgtcgcacgtggaggactcggactcggacgcgccgccgtctcccgccggctccgagggcctgggccgcgcgggggtcgcggtggggggcgcccggggcgacccggcggaggcggcggacgagcgcttcccggcctgcatccgcgacgccgtgtcgcaggtgctcaagggctacgactggagtctggtgcccatgccggtgcgcggcggcggcggcggcgcgctcaaagccaagccgcatgtgaagcggcccatgaacgcattcatggtgtgggcgcaggcggcgcgccgcaagctggccgaccagtacccgcacctgcacaacgccgagctcagcaagacgctgggcaagctgtggcgcttgctgagcgagagcgagaagcggcccttcgtggaggaggcagagcgccttcgcgtgcagcacaagaaggaccaccccgactacaagtaccagccacggcgcaggaagagcgccaaagccggccacagcgactccgactcgggcgcggagctgggaccccaccctggcggcggtgccgtgtacaaggctgaagcagggcttggagatgggcaccaccatggcgaccacacagggcagacccacgggccgcccaccccgcccaccacccccaagacggagctgcagcaggcgggcgccaagccggagctgaagctggagggacgccggccggtggacagcgggcgccagaacatcgacttcagcaatgtggacatctcggagctcagcagcgaggtcatgggcaccatggacgccttcgacgtccacgagttcgaccagtacctgcccctgggcggccccgccccacccgagccgggccaggcctatgggggcgcctacttccacgccggggcgtcccccgtgtgggcccacaagagtgccccgtcggcctccgcgtcgcccaccgagacgggtcccccacggccgcacatcaagacggagcagccgagccccggccactacggcgaccagccccgaggctcgcccgactacggttcctgcagcggccagtccagcgccaccccggccgcccccgccggccccttcgccggctcacagggcgactatggcgacctgcaggcctccagctactatggtgcctaccctggctacgcacccggcctctaccagtacccctgcttccactcgccgcgccggccctacgcctcacccctgctcaacggcctggccctgccgcccgcccacagccccaccagtcactgggaccagccggtgtacaccaccctgaccaggccctgagggcccagccgcggggagggactcgcaggcgtcagggggcagccttgtcccggcccagtgtgtgtgaccagggcgggaggggccccagtggctgagctccaagtgcctgctgaagtctgcagggaaacacgcttgctgcccgtggccctcggcctccagatggccacacctctgccgacgacggaccagctccctctcccttctatctttctttttgaggtggtgggattattccacaaagaagggctgccgtttggtccctcttccgtgaggactggcggcaccagcaccttcgctttgcatctcggtagaggagaaacggcagcacagcccaaggaccaaaggagggggtggcaggggccttgcagggcgctgtgaggtccaggccggtcttggcgccgagagcccctgcactcaaggccacattccctcgacaacggctgcacgggctgtccgggatccggggtgtctgtccgcagactgggatgagtctactcgagcatctccgggacctgcctgtcagatctgaggtgtctccttgctggcagagtgcgctcacgcgagggctggctgtgatgaacacatctctcttttatttttatgtttttgataatttttatttttgaagcttaaatgtgtttcttctgaaagctgttaaagatgtatttatgttctgtgttattttatctttaattaatgaggtaattcgggcaaagagtagaatttaagacaaaacggaagctgggaagcttcccttgagggcaggcaggaggtggagttgcagctgttggccggcatcacgttgctcgttgctcggcttatgggaggccgccctggagggcccggaggtcccaaggtccctgggaggactgggcccctcatgcctcgagcttggcaaccgaaaacccgagggaggagaagggacctgccttgtgacatctctgatcaggttggggtgccccagcacccagtaccagtttggggtttgggaagcaggactccgtccctgtccccgactgtgccacgtggtaggacacataggacacaggaattcctgggtccttgcccatgactgtgccatgtggtaggacacaggacacaggaattcctggaaagtggtggcttcagaagtgatcttggctcgcaggcaccagtgccacctaccaagctgtgaaactaaaccttctccactaaacgtcgttagggcctcagttctagacgagtcatacctgattcacctgcactgcttcccctgtgtgctgagcatagagcatacaatagcgcctacttcacggaaacttgtgcctttaaactttgtaaacttaaacacagccgagaagttgcttctttgtactttttctacttttcctacttttttgtagaaaaaaaagataatgcctctgcttctatttctctgggggtgggggtgggggccgggagccgtcgcagacccgtttcatgcagcgtctcccttggcaccgcgttcggaggacgcaccctcactcccctgctgccttcactcctttctgaccaagcaacgctaacttttgtacagatcgatttgataaaattaaacaaagtgctttttatgga

SEQ ID NO: 29995 - DNA, 3935 bp, Homo sapiens
ggagagccgaaagcggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagcccgcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgaagatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatcatatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttccaattttaccttctttaaaataggttgttggagctttcctcaaagggtatggtcatctgttgttaaattatgttcttaactgtaaccagtttttttttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctgcatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctcttttttttttttgtatattattgtttacaataaatatacattgcattaaaaagaaa

SEQ ID NO: 29996 - DNA, 1906 bp, Homo sapiens
gagccgaaagcggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagcccgcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgaagatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatg

SEQ ID NO: 29997 - DNA, 2837 bp, Homo sapiens
agtccgcggcgccacaagcctcagtgtttacttctgccgcctgccagccgggcggggaaggggagtacccggccacccctcactttagctcctgcagctttccaaacaaaccagggcgggatgggagtgtcttcttggctgtggaaatcgatcctcctaccttgtcctgaagccacccgccgcctttcctcgtccctcccttcgcggtgattttccggtcccggcgcccggcgagggcgcgcggctggtgtccgccccgcccgaaaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgagtcagagctctgcatatattttaagaaaaggcattgaggaactcaatcaaaccagtattcttttcacacaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacagtgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactggaaaa

SEQ ID NO: 29998 - DNA, 3148 bp, Homo sapiens
tttcctcgtccctcccttcgcggtgattttccggtcccggcgcccggcgagggcgcgcggctggtgtccgccccgcccgaaaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgagtcagagctctgcatatattttaagaaaaggcattgaggaactcaatcaaaccagtattcttttcacacaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaaaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattactaaactctgatggctttgtattattttaaagaaatgaagtttaactttatacagtgaagctaagctaggcaagctcaagaaggaaaaaaaaatcttgaacattatttttttttgcctgacttacttattcattaaattttgaaggttttccacttgaagtaaattaggaaaggtaaagaagataacagaacaagtaaacacttaagaaaagtcaagctgaggccgggcagggtggctcacacctgtaatcctaacaaacactttgggaggccgagggaggcagctggattgcctgaactcaggagttcaagaccagcctggccaacatggtgaaacctcatctctactaaaatacaaaataattagctgggcgtggtggtatgcgctgtagtcccaggtactcgggaggctgaggcacgagaattgcttgagcccgggaggcagaggttgcagtgagccaagatcgcgccactgcacttcagcctgggtgacagagtgaggctgtcttctaaaaaatataaaaagtgaagttgggatttttggatttaaatggtacaaaaagaatatctcattttcccatgattaaagctaatcttcagatggaaagcttgcctggctacctagggtgcaccagagaatctgatccaatgcaagccagtcaatcctacaaatgtggtgagctagtcttccttcctatattttaataaatgtaaccaaaggccatctggaggtaggggaatgagaggtgaagaaacagaaaaatagaggttataaggatggaactaaaagttgtcagaagaggtatgagctgaagaaagaattactctcttttgaccaataaatacaattgggaaacactggaaaaccatggcttgattactgacaaccaacctgcctctctaaagagggtgtataaagggtgaaatacattagatttggctcagaaacagaatgcggtacttataaagcagaataaaggggagaacagtagtagttgatctaacccagattagacatgaataccagcatatgtttgcagagtcccacagttttgattcctcttataactttttgaggtgcaaaaggaaggtaccagaactggaatcacatgtaatcaatcagtgtgattttcccctcataccacacagccataggctgcagtgtggctgctgaagttcaattgatataaagtaaatcaggcttcaaaaagaatggtgctgtgggtacacaaggacataaagatgggaacgatagacactgaggactgcggcggggggagcgaggggagcggggagggcaagggctgaaagactatgtattgggtactatgctcacaacctggatgatgggatcattcataccacaaacctcagtatcacacaatatacccatgtaacaacctgcactctgcacatgtacccttagaatctaaaataaaagttgaaattattttttt

SEQ ID NO: 29999 - DNA, 2449 bp, Homo sapiens
actatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccagtaagtatagtcactctagctcaccccaggagaagcctgttgcagattcagtggttctttcctttgactccgctggacaaacactaggctcagagtatgatcggttgggcttcctcctgaatctggactctaaactctcaccgaggactctctgcacggtggtttttggccttgactgcatattggaatcacctggagagcctaaaaaattactgatgcctgcatcccaccctctagagattttgaagtcactgagcgaggacacagcctttgcattaggatttttaaagctgcccaggcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatccataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctg

SEQ ID NO: 30000 - DNA, 1601 bp, Homo sapiens
actatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatccataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctg

SEQ ID NO: 30001 - DNA, 1035 bp, Homo sapiens
atgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctga

SEQ ID NO: 30002 - DNA, 2007 bp, Homo sapiens
actatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatccataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctg

SEQ ID NO: 30003 - DNA, 1324 bp, Homo sapiens
cgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccagtaagtatagtcactctagctcaccccaggagaagcctgttgcagattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctga

SEQ ID NO: 30004 - DNA, 2356 bp, Homo sapiens
actatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaagtatgatcggttgggcttcctcctgaatctggactctaaactctcaccgaggactctctgcacggtggtttttggccttgactgcatattggaatcacctggagagcctaaaaaattactgatgcctgcatcccaccctctagagattttgaagtcactgagcgaggacacagcctttgcattaggatttttaaagctgcccaggcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatccataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctg

SEQ ID NO: 30005 - DNA, 1948 bp, Homo sapiens
actatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatccataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctg

SEQ ID NO: 30006 - DNA, 2243 bp, Homo sapiens
actatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatccataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctga

SEQ ID NO: 30007 - DNA, 2195 bp, Homo sapiens
actatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatccataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctga

SEQ ID NO: 30008 - DNA, 1335 bp, Homo sapiens
atgggactcttggtatttgtgcgcaatctgctgctagccctctgcctctttctggtactgggatttttgtattattctgcgtggaagctacacttactccagtgggaggaggactccagtaagtatagtcactctagctcaccccaggagaagcctgttgcagattcagtggttctttcctttgactccgctggacaaacactaggctcagagtatgatcggttgggcttcctcctgaatctggactctaaactctcaccgaggactctctgcacggtggtttttggccttgactgcatattggaatcacctggagagcctaaaaaattactgatgcctgcatcccaccctctagagattttgaagtcactgagcgaggacacagcctttgcattaggatttttaaagctgcccaggcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctga

SEQ ID NO: 30009 - DNA, 513 bp, Homo sapiens
atgggactcttggtatttgtgcgcaatctgctgctagccctctgcctctttctggtactgggatttttgtattattctgcgtggaagctacacttactccagtgggaggaggactccagtaagtatagtcactctagctcaccccaggagaagcctgttgcagattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagtcctggacgcacaatatccagcgagagaaagagtttctgcggaagctggtgaaagctcgcgtcatcactga

SEQ ID NO: 30010 - DNA, 468 bp, Homo sapiens
atgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagtcctggacgcacaatatccagcgagagaaagagtttctgcggaagctggtgaaagctcgcgtcatcactga

SEQ ID NO: 30011 - DNA, 673 bp, Homo sapiens
atgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgaggtgagctccccaaaatggcacctcggtcctggacgcacaatatccagcgagagaaagagtttctgcggaagctggtgaaagctcgcgtcatcactgatctaagcagtggcatctga

SEQ ID NO: 30012 - DNA, 670 bp, Homo sapiens
atgggactcttggtatttgtgcgcaatctgctgctagccctctgcctctttctggtactgggatttttgtattattctgcgtggaagctacacttactccagtgggaggaggactccagtaagtatagtcactctagctcaccccaggagaagcctgttgcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgaggtgagctccccaaaatggcacctcggtcctggacgcacaatatccagcgagagaaagagtttctgcggaagctggtgaaagctcgcgtcatcactgatctaagcagtggcatctga

SEQ ID NO: 30013 - DNA, 644 bp, Homo sapiens
atgggactcttggtatttgtgcgcaatctgctgctagccctctgcctctttctggtactgggatttttgtattattctgcgtggaagctacacttactccagtgggaggaggactccagtaagtatagtcactctagctcaccccaggagaagcctgttgcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagtcctggacgcacaatatccagcgagagaaagagtttctgcggaagctggtgaaagctcgcgtcatcactgatctaagcagtggcatctga

SEQ ID NO: 30014 - DNA, 1290 bp, Homo sapiens
atgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactctcaccgaggactctctgcacggtggtttttggccttgactgcatattggaatcacctggagagcctaaaaaattactgatgcctgcatcccaccctctagagattttgaagtcactgagcgaggacacagcctttgcattaggatttttaaagctgcccaggcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctga

SEQ ID NO: 30015 - DNA, 1038 bp, Homo sapiens
atgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctga

SEQ ID NO: 30016 - DNA, 1242 bp, Homo sapiens
atgggactcttggtatttgtgcgcaatctgctgctagccctctgcctctttctggtactgggatttttgtattattctgcgtggaagctacacttactccagtgggaggaggactccaagtatgatcggttgggcttcctcctgaatctggactctaaactctcaccgaggactctctgcacggtggtttttggccttgactgcatattggaatcacctggagagcctaaaaaattactgatgcctgcatcccaccctctagagattttgaagtcactgagcgaggacacagcctttgcattaggatttttaaagctgcccaggcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctga

SEQ ID NO: 30017 - DNA, 2149 bp, Homo sapiens
actatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatccataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctg

SEQ ID NO: 30018 - DNA, 2404 bp, Homo sapiens
actatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactctcaccgaggactctctgcacggtggtttttggccttgactgcatattggaatcacctggagagcctaaaaaattactgatgcctgcatcccaccctctagagattttgaagtcactgagcgaggacacagcctttgcattaggatttttaaagctgcccaggcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatccataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctg

SEQ ID NO: 30019 - DNA, 1895 bp, Homo sapiens
actatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagagtgcatcggatggcttctggaaatctgtggccactcgagtgcccaaggagccccctgagattcgaatcctcaacccatatttcatccaggaggccgccttcaccctcattggcctgcccttcaacaatggcctcatgggccgggggaacatccctacccttggcagtgtggcagtgaccatggcactacacggctgtgacgaggtggcagtcgcaggatttggctatgacatgagcacacccaacgcacccctgcactactatgagaccgttcgcatggcagccatcaaagagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatccataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctg

SEQ ID NO: 30020 - DNA, 599 bp, Homo sapiens
atgggactcttggtatttgtgcgcaatctgctgctagccctctgcctctttctggtactgggatttttgtattattctgcgtggaagctacacttactccagtgggaggaggactccaagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagtcctggacgcacaatatccagcgagagaaagagtttctgcggaagctggtgaaagctcgcgtcatcactgatctaagcagtggcatctga

SEQ ID NO: 30021 - DNA, 420 bp, Homo sapiens
atgggactcttggtatttgtgcgcaatctgctgctagccctctgcctctttctggtactgggatttttgtattattctgcgtggaagctacacttactccagtgggaggaggactccaagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagtcctggacgcacaatatccagcgagagaaagagtttctgcggaagctggtgaaagctcgcgtcatcactga

SEQ ID NO: 30022 - DNA, 344 bp, Homo sapiens
atgggactcttggtatttgtgcgcaatctgctgctagccctctgcctctttctggtactgggatttttgtattattctgcgtggaagctacacttactccagtgggaggaggactccaagtatgatcggttgggcttcctcctgaatctggactctaaactgcctgctgaattagccaccaagtacgcaaacttttcagagggagcttgcaagcctggctatgcttcagccttgatgacggccatcttcccccgtcctggacgcacaatatccagcgagagaaagagtttctgcggaagctggtgaaagctcgcgtcatcactgatctaagcagtggcatctga

SEQ ID NO: 30023 - DNA, 786 bp, Homo sapiens
atgggactcttggtatttgtgcgcaatctgctgctagccctctgcctctttctggtactgggatttttgtattattctgcgtggaagctacacttactccagtgggaggaggactccaagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgtcctggacgcacaatatccagcgagagaaagagtttctgcggaagctggtgaaagctcgcgtcatcactgatctaagcagtggcatctga

SEQ ID NO: 30024 - DNA, 834 bp, Homo sapiens
atgggactcttggtatttgtgcgcaatctgctgctagccctctgcctctttctggtactgggatttttgtattattctgcgtggaagctacacttactccagtgggaggaggactccaattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagacaatctgatcaaagccatcttgtcagtcaccaaagagtaccgcctgacccctgccttggacagcctccgctgccgccgctgcatcatcgtgggcaatggaggcgttcttgccaacaagtctctggggtcacgaattgacgactatgacattgtggtgagactgaattcagcaccagtgaaaggctttgagaaggacgtgggcagcaaaacgacactgcgcatcacctaccccgagggcgccatgcagcggcctgagcagtacgagcgcgattctctctttgtcctcgccggcttcaagtggcaggactttaagtggttgaaatacatcgtctacaaggagagagtgtcctggacgcacaatatccagcgagagaaagagtttctgcggaagctggtgaaagctcgcgtcatcactgatctaagcagtggcatctga

SEQ ID NO: 30025 - DNA, 1646 bp, Homo sapiens
actatggcggcgcccatgcagcccagcgcgttgtgggctcccgccggggtcccccgcggctgtcgccgccgcctacgccgctgcctccgccttcctgccccgcgtcgggccgggcgccacctcccccctgcctccctctccgctgtggtcatttaggaaatcgtaaatcatgtgaagatgggactcttggtatttgtgcgcaatctgctgctagccctctgcctctttctggtactgggatttttgtattattctgcgtggaagctacacttactccagtgggaggaggactccagtaagtatagtcactctagctcaccccaggagaagcctgttgcagattcagtggttctttcctttgactccgctggacaaacactaggctcagagtatgatcggttgggcttcctcctgaatctggactctaaactgcctgctgaattagccaccaagtacgcaaacttttcagagggagcttgcaagcctggctatgcttcagccttgatgacggccatcttcccccggttctccaagccagcacccatgttcctggatgactcctttcgcaagtgggctagaatccgggagttcgtgccgccttttgggatcaaaggtcaagtcctggacgcacaatatccagcgagagaaagagtttctgcggaagctggtgaaagctcgcgtcatcactgatctaagcagtggcatctgagtgggcccagcacatggccatagaggcccaggcaccaccaggagcagcagccagcaccacctacacaggagtcttcagacccagagaaggacggtgccaagggccccaggggcagcaaggccttggtggagcagccagagctgtgcctgctcagcagccagtctcagagaccagcactcagcctcattcagcatgggtccttgatgccagagggccagcaggctcctggctgtgcccagcaggcccagcatgcaggtggtgggacactgggcagcaaggctgctgccggaatcacttctccaatcagtgtttggtgtattatcattttgtgaatttgggtaggggggagggtagggataatttatttttaaataaggttggagatgtcaagttgggttcacttgccatgcaggaagaggcccactagagggcccatcaggcagtgttacctgttagctccctgtggggcaggagtgccaggaccagcctgtaccttgctgtggggctacaggatggtgggcaggatctcaagccagccccctccagctcatgacactgtttggcctttcttggggagaaggcggggtattcccactcaccagccctagctgtcccatggggaaaccctggagccatcccttcggagccaacaagaccgccccagggctatagcagaaagaactttaaagctcaggagggtgacgcccagctccgcctgctgggaagagctcccctccacagctgcagctgatccataggactaccgcaggcccggactcaccaacttgccacatgttctaggtttcagcaacaagactgccaggtggttgggttctgcctttagcctggaccaaagggaagtgaggcccaaggagcttacccaagctgtggcagccgtcccaggccacccccatggaagcaataaagctcttccctg

SEQ ID NO: 30026 - DNA, 3148 bp, Homo sapiens; identical to SEQ ID NO: 29998

SEQ ID NO: 30027 - DNA, 2092 bp, Homo sapiens
gagcctgagactccgggcagggctgctccctcctctgctcccccgccagatccgcggggaaggaatcgtgcccgcgccgcccctggcccgcgccaccttcctttggtttctgccggcctcgggcttctgcggcccgatgtggcaggcgccgcgagagaggcagcagccggctggagcagcggcccctcaggtctcggagcccggtgcgcctctgcggtcgtcgctcctgggcctcggcgggtcactcttgccggccggcttcgctgcgggtttgcactgcccggcatttgcaagtgaggaagcagcacaaccctgggttttagataatttctaacagagaggccccagcaattcagcaggcagcgtcctgagtctttggcagcctggtccctctttcgcaaattctccacctttgcgaacagagggtctttaggacacagattcttaaaagtgcaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagtaaataactaaagaaagaatacaattact

SEQ ID NO: 30028 - DNA, 1886 bp, Homo sapiens
gtgtcacagtcagtccgcggcgccacaagcctcagtgtttacttctgccgcctgccagccgggcggggaaggggagtacccggccacccctcactttagctcctgcagctttccaaacaaaccagggcgggatgggagtgtcttcttggctgtggaaatcgatcctcctaccttgtcctgaagccacccgccgcctttcctcgtccctcccttcgcggtgattttccggtcccggcgcccggcgagggcgcgcggctggtgtccgccccgcccgaaaggtgagccagccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatcctttcattatcagaacagcagcttatgaactgcttcattttccaaaagtgtttcccaaaaatcagaaacctaaacacccaacaacaggaattattgccatcacattggcgttttacatatgtcacgaagttcacctagctggttttaaatacaacttttctgacctcaagagtcctttgcactactatgggaatgccaccatgtctttgatgaataagaacgcgtatcacaatgtgactgcagagcagctctttttgaaggacattatagaaaaaaacctcgtaatcaacttgactcaagattgactctacagactcagaagatgatgctaacagtgttagttttatttttgtactgcaatttttagtttaaaatatgttggatgcactcgtcaaataattatgtatactgtctgttgctgcctggtgattcataaccaccagcttaatttctgtgaatactgtatatttaacttatgaaaaccaagaaatgtaaagataacaggaaaataagttttgattgcattgtttttaaaataagctagttttctgaggtgttttcacacgtctttttatagttacttcatcttagatttttgaagggatatgacttcctactaaggatttagtttaccacaacaattctgactacaataagacattttgaggaggatatttggctactgtaaacatggctggtggaaaatcacgattgtggcttgatgtggcaagccgaaaccacttggctctggaaatctaagttcatactggtttaattaagctctctcctgacaacccccagaattaaatgaaccatgattgtgaagagtaatttggtacaatgaaggcagtgtttgtttttaagttaaaggaaatgggctaaacataaagttcttattagataagt

SEQ ID NO: 30029 - DNA, 750 bp, Homo sapiens
ggcgctcggcgcagtcgcccgggattggggctggcgggagcctgagactccggccatgagagggtatcttgtggccatattcctgagtgctgtcttcctctattatgtactgcattgcatattatggggaacgaatgtctattgggtggcacctgtggaaatgaaacggagaaataagatccagccttgtttatcaaagccagcttttgcctctctgctgaggtttcatcagtttcacccttttctgtgtgcggctgattttagaaagattgcttccttgtatggtagcgataagtttgatttgccctatgggatgagaacatcagcggaatattttcgacttgctctttcaaaactgcagagttgtgatctctttgatgagtttgacaacataccctgtaaaaagtgtgtggtggttggtaatggaggagttttgaagaataagacattaggagaaaaaatcgactcctatgatgtaataataagaatgaataatggtcctgttttaggacatgaagaagaagttgggagaaggacaaccttccgacttttttatccagaatctgttttttcagatcctattcacaatgaccctaatacgacagtgattctcactgcttttaagccacatgatttaaggtggctgttggaattgttgatgggtgacaaaataaacactaatggtttttggaagaaaccagccttaaacctgatttataaaccttatcaaatccgaatattagatccttt

SEQ ID NO: 30030 - DNA, 1291 bp, Homo sapiens
gtctctaatctctgcaacagccgcgcttcccgggtcccgcggctcccgcgcgcgatctgccgcggccggctgctgggcaaaaatcagagccgcctccgccccattacccatcatggaaaccctccaggaaaaagtggccccggacgcgcgagcctgaggattctgcacaaaagaggtgcccaaaatgaagaccctgatgcgccatggtctggcagtgtgtttagcgctcaccaccatgtgcaccagcttgttgctagtgtacagcagcctcggcggccagaaggagcggcggagagcagcacccagcagcgccccggggtccccgcgggaccgcggccactggacggatacctcggagtggcggaccacaagcccctgaaaatgcactgcagggactgtgccctggtgaccagctcagggcatctgctgcacagtcggcaaggctcccagattgaccagacagagtgtgtcatccgcatgaatgacgcccccacacgcggctatgggcgtgacgtgggcaatcgcaccagcctgagggtcatcgcgcattccagcatccagaggatcctccgcaaccgccatgacctgctcaacgtgagccagggcaccgtgttcatcttctggggccccagcagctacatgcggcgggacggcaagggccaggtctacaacaacctgcatctcctgagccaggtgctgccccggctgaaggccttcatgattactcgccacaagatgctgcagtttgatgagctcttcaagcaggagactggcaaagacaggaagatatccaacacttggctcagcactggctggtttacaatgacaattgcactggagctctgtgacaggatcaatgtttatggcatggtgcccccagacttctgcagggatcccaatcacccttcagtaccttatcattattatgaaccttttggacctgatgaatgtacaatgtacctctcccatgagcgaggacgcaagggcagtcatcaccgctttatcacagagaaacgagtctttaagaactgggcacggacattcaatattcacttttttcaaccagactggaaaccagaatcacttgctataaatcatcctgagaataaacctgtgttctaaggaatgagcatgccagactgtaatcccaggtattcactgcatcagacaccgagacactgaacttcctgagccaccagacaggaaagggtagcagaaaacagcttcactcctcaggaagtaccatggacagacgcctaccaggggtgacaaagcagtgcagttggattgt

SEQ ID NO: 30031 - DNA, 3751 bp, Homo sapiens
agttgtgtagatcgctgagagactacgagggtccggttcagttttaattctgtctctaatctctgcaacagccgcgcttcccgggtcccgcggctcccgcgcgcgatctgccgcggccggctgctgggcaaaaatcagagccgcctccgccccattacccatcatggaaaccctccaggaaaaagtggccccggacgcgcgagcctgaggattctgcacaaaagaggtgcccaaaatgaagaccctgatgcgccatggtctggcagtgtgtttagcgctcaccaccatgtgcaccagcttgttgctagtgtacagcagcctcggcggccagaaggagcggcccccgcagcagcagcagcagcagcagcaacagcagcagcaggcgtcggccaccggcagctcgcagccggcggcggagagcagcacccagcagcgccccggggtccccgcgggaccgcggccactggacggatacctcggagtggcggaccacaagcccctgaaaatgcactgcagggactgtgccctggtgaccagctcagggcatctgctgcacagtcggcaaggctcccagattgaccagacagagtgtgtcatccgcatgaatgacgcccccacacgcggctatgggcgtgacgtgggcaatcgcaccagcctgagggtcatcgcgcattccagcatccagaggatcctccgcaaccgccatgacctgctcaacgtgagccagggcaccgtgttcatcttctggggccccagcagctacatgcggcgggacggcaagggccaggtctacaacaacctgcatctcctgagccaggtgctgccccggctgaaggccttcatgattactcgccacaagatgctgcagtttgatgagctcttcaagcaggagactggcaaagacaggaagatatccaacacttggctcagcactggctggtttacaatgacaattgcactggagctctgtgacaggatcaatgtttatggcatggtgcccccagacttctgcagggatcccaatcacccttcagtaccttatcattattatgaaccttttggacctgatgaatgtacaatgtacctctcccatgagcgaggacgcaagggcagtcatcaccgctttatcacagagaaacgagtctttaagaactgggcacggacattcaatattcacttttttcaaccagactggaaaccagaatcacttgctataaatcatcctgagaataaacctgtgttctaaggaatgagcatgccagactgtaatcccaggtattcactgcatcagacaccgagacactgaacttcctgagccaccagacaggaaagggtagcagaaaacagcttcactcctcaggaagtaccatggacagacgcctaccaggggtgacaaagcagtgcagttggattgtaaggaaaaattccggaattaatgcatcctaatgaatgttgtccccttcaatggtgttaccttaggagctgaacattcaattcagttacaccactatgactaaaaacagtttggatctcttagtattgcctttgaaactgcaacataagcaactcaacaatattagttgcattcctttatagacataccatgtcaaagacgtttttctatcaagttgtattctttcctgttctataacctttgtcatctgttagactctgtatgtgtgatttgtaaaaagcaggctgaaactatggacatgatttctgaagagcacatctccactgactttcataaagcaaatgtccaatatttatttattgagagttttttagtgcaatctgggccagtatttttatagattatgattatgtggtaatttatccttcctaactctttaatcctgaatgatggttggaaatggcctagaattaggttactctgttcacaatgctcattgttagcatgcaattggtatttgacttggaagtgttgtgttgtattttttgaacccctaggcttcaggaaaactgctcttttgtaaaaagaatagcgatgacattttctaatgtgcagaaatgttccaaaaggacaaaattgaaaaccaaaaactatgttattaaaacaaaaaaatgctaacaagagaaatttaaaggtagttttctttagtaataatttatgtaagtgtcctctcttgagccctagtttcctttttggcagaatgatgtcactgtaccagacaacctcttaggtttcatcccaaatctaaacttgtggcctcttcttgacccatttgaagactctgcacttggagtgatggggccccaacagtagcaggaactttattttggggagccttatctacattcatattacttatatcactcttgtggttaaaactacacttcttcctgtgtccacatgggctaaaatctaccccctgcttctctcgaagcatcaccatccgcctcttccccagcctctcaacacaaaaacacaggatacacacacacacacacacacaaaagacatagctccaaggggttccctggctacaatagcaaacagctgcccttctgtgaggaaaagagactacaaggacatgccctatcattcaactcatttatgctatgaactgtttagactcactacaaatcttcttagattatattcattaccattccctggtctgaaggagtataaaggacttattttattcagagccaagataaattcatattatagatttttatttaaacaagtaatattgttcaaaaatagtctcttataaatatactagtgttttctttacacatgacttagaaggcattagtttctctaatgccaaatttgaaggcaccagcaaatattatgtatgaagactgacattgttttacagacatgacctggcttatgataaaagaagttttatcgcattaccacttcttttcccttttcttaattagtacactaactagtactattaattacacggagtattgttgttaaaatgcaaacacaatcagggtactcacataacataaacaaagttgatattgatgtgtatggcttgggctgttcaaagccagtaagattgaaatggccgtccaaaacatactggaatatgttctttaagttttctcatagtttttaaagggactatgaattttattccaacacattgtcttccacagcatggactctgaacacatcatactttatcaacatatgaaaaagtgtattaattttatacaatttacttataggccacctttataatcacttgaagacgttatgttgctcaaacataagtggctcctttggcaatttctatatttgtggaaatttggaaaggcatagtttcaacatgcaagaatgtaattatattgcttcatctaataatatctcacatatctgtctatcttcagattttagattttctttattaaaaaaaccatcatggtagctccatctcgtttgtaacttctccctctcaaatactcagaagaatgaagaggccaaattcagaaaatcatggcttcactgggaaatgttttaaatctacatgtagctaggatatgtgatttcatattttttaaaaatgtggtgtaaataagtgtaaaaaattaccacttgcaaagtggttttattacagcgttaaagaaaatgactagaattctgatagattgtgctgatgaacctggttgtgggcaattgaattcttgtcttcccactaccatttcatgactgtcgtctgaacactattcaacaccattaaatataaactctgatataaaa

SEQ ID NO: 30032 - DNA, 1949 bp, Homo sapiens
acgtttccggaacctccgggtgtcatccgcggggaaagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatgccttcgaggagatgatccggaaccaggagctagaaaaagagcgactgaaaattgtacaggagtttgggaaggtagaccctggcctaggtggcccgctagtgcctgacttggagaagccctccttagatgtgttccccaccttaacagtctcatccatacagccttcagactgtcacacaactgtaaggccagctaagccacctgtggtggacaggtccttgaaacctggagcactgagcaactcagaaagtattcccacaatcgatggattgcgccatgtggtggtgcctgggcggctgtgcccacagtttctccagttagccagtgccaacactgcccggggagtggagacatgtggaattctctgtggaaaactgatgaggaatgaatttaccattacccatgttctcatccccaagcaaagtgctgggtctgattactgcaacacagagaacgaagaagaacttttcctcatacaggatcagcagggcctcatcacactgggctggattcatactcaccccacacagaccgcgtttctctccagtgtcgacctacacactcactgctcttaccagatgatgttgccagagtcagtagccattgtttgctcccccaagttccaggaaactggattctttaaactaactgaccatggactagaggagatttcttcctgtcgccagaaaggatttcatccacacagcaaggatccacctctgttctgtagctgcagccacgtgactgttgtggacagagcagtgaccatcacagaccttcgatgagcgtttgagtccaacaccttccaagaacaacaaaaccatatcagtgtactgtagccccttaatttaagctttctagaaagctttggaagtttttgtagatagtagaaaggggggcatcacctgagaaagagctgattttgtatttcaggtttgaaaagaaataactgaacatattttttaggcaagtcagaaagagaacatggtcacccaaaagcaactgtaactcagaaattaagttactcagaaattaagtagctcagaaattaagaaagaatggtataatgaacccccatatacccttccttctggattcaccaattgttaacatttttttcctctcagctatccttctaatttctctctaatttcaatttgtttatatttacctctgggctcaataagggcatctgtgcagaaatttggaagccatttagaaaatcttttggattttcctgtggtttatggcaatatgaatggagcttattactggggtgagggacagcttactccatttgaccagattgtttggctaacacatcccgaagaatgattttgtcaggaattattgttatttaataaatatttcaggatatttttcctctacaataaagtaacaattaactt

SEQ ID NO: 30033 - DNA, 6691 bp, Homo sapiens
ggtggggcagggcctccgagcgtggttggactttgaaggggatcggccgccgtgagtgtggggcctgcagcctactctccccgagtcccctgcccggcctgcctcgctcgaggcacccgacggcttctgtctccgcgggctggcgcctgaccagccaggcccagcggttccccgcctactgcatttgaaagatcccgaaaaccctggatgattgtgcctggggttggcaagttcgtcttgagtgccttcaagaagggttcctcaagcagttgtcgatagagccctccctactgtatacgccccctccgctcattcctgctacttcctttctcctcctcgtatttccccctcggtcctttacgccgcctttccccctcatttgcagatgctgcatcccctttttggaattgctcaaccaggtggtaaccggcgccgcttcctggccttgggaggtggttcctttcttaacccacaagaacctctcccaagagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatgccttcgaggagatgatccggaaccaggagctagaaaaagagcgactgaaaattgtacaggagtttgggaaggtagaccctggcctaggtggcccgctagtgcctgacttggagaagccctccttagatgtgttccccaccttaacagtctcatccatacagccttcagactgtcacacaactgtaaggccagctaagccacctgtggtggacaggtccttgaaacctggagcactgagcaactcagaaagtattcccacaatcgatggattgcgccatgtggtggtgcctgggcggctgtgcccacagtttctccagttagccagtgccaacactgcccggggagtggagacatgtggaattctctgtggaaaactgatgaggaatgaatttaccattacccatgttctcatccccaagcaaagtgctgggtctgattactgcaacacagagaacgaagaagaacttttcctcatacaggatcagcagggcctcatcacactgggctggattcatactcaccccacacagaccgcgtttctctccagtgtcgacctacacactcactgctcttaccagatgatgttgccagagtcagtagccattgtttgctcccccaagttccaggaaactggattctttaaactaactgaccatggactagaggagatttcttcctgtcgccagaaaggatttcatccacacagcaaggatccacctctgttctgtagctgcagccacgtgactgttgtggacagagcagtgaccatcacagaccttcgatgagcgtttgagtccaacaccttccaagaacaacaaaaccatatcagtgtactgtagccccttaatttaagctttctagaaagctttggaagtttttgtagatagtagaaaggggggcatcacctgagaaagagctgattttgtatttcaggtttgaaaagaaataactgaacatattttttaggcaagtcagaaagagaacatggtcacccaaaagcaactgtaactcagaaattaagttactcagaaattaagtagctcagaaattaagaaagaatggtataatgaacccccatatacccttccttctggattcaccaattgttaacatttttttcctctcagctatccttctaatttctctctaatttcaatttgtttatatttacctctgggctcaataagggcatctgtgcagaaatttggaagccatttagaaaatcttttggattttcctgtggtttatggcaatatgaatggagcttattactggggtgagggacagcttactccatttgaccagattgtttggctaacacatcccgaagaatgattttgtcaggaattattgttatttaataaatatttcaggatatttttcctctacaataaagtaacaattaacttatgtttttgtgcttcagagtgatccatttgatcaagcattgtataaacaggttaaaaaaaaggtatggttgttttggaaaggtgaaggaaaaatggaatttgagatatactgacactgatggtgtgtcccagttcacttttaattactccttgttttttatctgcctgttgccatcttccagaggtgttgtgaagtcatctctgttcttttggtgctgtctcaaatgggtcaaccattcacttcctccttatgccctccatgcttttggctgaggataatgaagcctttgtttggagtaccaggttacactccaataaatgattacatttcccagccaccccaccctaccaatttcattgtgttggctgttcttttctgactaaggcaatacctaggaaaacgcttgaagcagcaattgttactgcaattttctgtgagctgagcctggtgttctaggtggcctagaaataatggtgtcatttgtgacacctcgagtgagggcaggagagtaaatactttggctaggagaagagtgatttattctttatcagaattctaggtgggggagggagaatctgtgaatgcataaagttttcttcatttttaaattttgtctcagtctttattgcttaggttagtggtccttgaacttgtcccctgaaagagcccagttctctatattctttttcttctcttgggttcttaattccccatatagtggaaattccttctttgctgttttggtatgggtgggtctgggggccagctgggcttggacaagccatttcctgctgcagcccagagcagcctggctgttccaccttgctctaaacagtcctgaaattgcccagtcctctgcttttgggaaatccatccccttcttcccattctttgtctaccacttagcttagggctttcttaccttttatttcgactgtagccgttggcttttaccaagtctctttgtttttagcatttcttcattccagtctgttctgcacactttgatcaggagaagcttctcacattccagccatgttcatgttttctctcttgctcaaaaacctgcaatagcttcccattgctgaaaatctaaatttagcttttagtcagaactttccacttaaagttcttacccctggctatatattcaaatatctagggagcaatttaaaaaatactgatgcctgtgttctaccccccaccaattaaagctgaatctctagggtggagcctcagatgttgtttctgcatttgtctttcaagctgctagaattctcaagtacaaccagggttgacaaccactgcattggtctttgatacctaagaattgtgagctctcttatccgtctctgcccaccaaagacattcagccaggtcaacaacatatcatacgttgcaaccacattgatcacagactgatcaccaaactgctatattttcttttctcttcctctaggcacaagatatcttagtggctagatgggtgcaggaaatcagtctgtagatccctcttcatatctgctgcagcctagccactgcagaggcactctgcataggatggtctaagtgtctctgtcttcatcttacctctgtggaggagacgtggaatcaagccagcccacaagccctgagactggataggccggagagaaagaggagtagccagagcggtcgggaaaagaggaaaggaatactgtgggtaaaagggacaaagaccacgcaacctgaggaaagacattgtattgaaagggtaatgactatttggctaaagggactgactcctgggttcccgaggctcaaagaccaggagacttttccactcttgcaagctgcacaagtaccatacttagtgttctgggctgagaggggagacaaaagcatcgtcaggttgccaaacaatgtcccagttgccctgggaggcacaaacctaccaaagtgccataggccaggtgcagagagaatcagaggagctgatttgcttggggtcagagcagagctgggttttttcagatgatcactttcacatactccttgttaaatgggaccaaaggggaagaagaagaaacccttaagcttttgtaatattgtcttgggtaccagataccataaaaggcagcatgagagaaacattcccttgggccagtgtcatggtggattttcttgcttgagaggcaaggatttcagctttcatttggtaccacagaatttaaaattgtaagtgcctatcccttttgactgttgatggcttctttggggttttagttaccccagttgaaagagaaatttttcatattggggttgagaagaatggaggctattaggagcaaagctttaatgagtgaaagtctggtgaatcctgcaattttgatatgtttccagtggattttgagaacacagttttaggaccagagtagatgttgttccctagaaaatagagtcagctattgatattgtgcctcccatccctcatatctcagtgttttaaccccacctgagtttggagaccagtttgtccaaggatctttcaaacatgtgagcccagagtagaacttctgagtcaaggatcatgtctttttctgaggagctttgcttggggcactggaaatcctgtttagatcaggactattggaatattatcctctccaggggaagtgccaggttgaacatttaaggctttgcttctaggcccagctatacattcaccagcaaatcacttaacttcctaaatttctttaaaatctgtaaaatgggatcagtctaatatgcctacctcaaatgatgacagaatgacatctatatgcatatgaggcctacgttagttgaaagatgctataaagatataagggatttgttacttgtctttcttgaaatgttacagttggggtgcggttgcttctatcttctggacctctgcccattcagcatacagctagaggaatctttgggcagatccacattctttagcactagctaggctttgactccaaagctatctggtctaccttgatgttctgagcaggaaaactgaggacctcaagaaccattccaaatttctactcattctccctaagacccagagcagacccaggacctaaagaaattacatcatctctattttcccttggctccagcccactcttgtttgaacctcccacttttgttgttccaactacttcttgagatgaaggaagggcagaacattggccctcttcactgaagtcttcaccccttaatccagggttcaatttttagttcaccttagcctgtttgagattagaagctgggccttaacttacaggtgtgtccggcatcattcaatcagcctgttagatccagaatccagcactgtgacgctacataaccatgggctctgtccttccagttcctttagtgccttccctcactggtaggttcactctgagggcttccttccttgaactccagtggcaactatagtctgtttcccacaatttgttgtgtgtgttttttgttgttttgcagcgttttcatattgtcttttatgtaagtcatgtttctgaactatcgtataaatttcattagggtaagaatcatgtttgctttatgcactgtgtaacatgccttgcagtcagtataggcacttaaccttattgatcagttgttccttggtgttgaataatgtgttaggtagccaggtggacctgtgtcctagcctggagaagctctatgtcaccttgtaggaagccatctgaatttgactcagcatcatatgctgggcctgtgctgcacttgagctttctttccagccgccaggagggatggttgtcctggccaacagcgaatttaatgggtggtcaaaagaagatgtgcctgcatagaaggctgaaagagggagctggaagtaggaggagacaaggagatagtgacaccagtatcttgtcacagaaatcaaggaaggcaacagtttaaaggaggggagggagatcagtggtgccaactggctcagaagaggtttgctgggttaaatctcaagatgagcccatgagatctggtggttagcagaggcctttcctgacaaccccattttaagcacctcttccccatcactctatctcatcactgttactgtctgtgtagccctgtcatgagctaaaatcatcctgtttgtttattgctagcttatgtgtctaaagtatactccttgagaacagcaactttgtctttttcacctttgtactgagtcccctgacatggaataagatatgaataaatgcacagacttgtccaaaatcatccaattaataaa

SEQ ID NO: 30034 - DNA, 2088 bp, Homo sapiens
gggaagggtcccgggaacgtggtggggcagggcctccgagcgtggttggactttgaaggggatcggccgccatgctgcatcccctttttggaattgctcaaccaggtggtaaccggcgccgcttcctggccttgggaggtggttcctttcttaacccacaagaacctctcccaagagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatgccttcgaggagatgatccggaaccaggagctagaaaaagagcgactgaaaattgtacaggagtttgggaaggtagaccctggcctaggtggcccgctagtgcctgacttggagaagccctccttagatgtgttccccaccttaacagtctcatccatacagccttcagactgtcacacaactgtaaggccagctaagccacctgtggtggacaggtccttgaaacctggagcactgagcaactcagaaagtattcccacaatcgatggattgcgccatgtggtggtgcctgggcggctgtgcccacagtttctccagttagccagtgccaacactgcccggggagtggagacatgtggaattctctgtggaaaactgatgaggaatgaatttaccattacccatgttctcatccccaagcaaagtgctgggtctgattactgcaacacagagaacgaagaagaacttttcctcatacaggatcagcagggcctcatcacactgggctggattcatactcaccccacacagaccgcgtttctctccagtgtcgacctacacactcactgctcttaccagatgatgttgccagagtcagtagccattgtttgctcccccaagttccaggaaactggattctttaaactaactgaccatggactagaggagatttcttcctgtcgccagaaaggatttcatccacacagcaaggatccacctctgttctgtagctgcagccacgtgactgttgtggacagagcagtgaccatcacagaccttcgatgagcgtttgagtccaacaccttccaagaacaacaaaaccatatcagtgtactgtagccccttaatttaagctttctagaaagctttggaagtttttgtagatagtagaaaggggggcatcacctgagaaagagctgattttgtatttcaggtttgaaaagaaataactgaacatattttttaggcaagtcagaaagagaacatggtcacccaaaagcaactgtaactcagaaattaagttactcagaaattaagtagctcagaaattaagaaagaatggtataatgaacccccatatacccttccttctggattcaccaattgttaacatttttttcctctcagctatccttctaatttctctctaatttcaatttgtttatatttacctctgggctcaataagggcatctgtgcagaaatttggaagccatttagaaaatcttttggattttcctgtggtttatggcaatatgaatggagcttattactggggtgagggacagcttactccatttgaccagattgtttggctaacacatcccgaagaatgattttgtcaggaattattgttatttaataaatatttcaggatatttttcctctacaataaagtaacaattaactt

SEQ ID NO: 30035 - DNA, 1649 bp, Homo sapiens
tttccggaacctccgggtgtcatccgcggggaaagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatgccttcgaggagatgatccggaaccaggagctagaaaaagagcgactgaaaattgtacaggagtttgggaaggtagaccctggcctaggtggcccgctagtgcctgacttggagaagccctccttagatgtgttccccaccttaacagtctcatccatacagccttcagactgtcacacaactgtaaggccagctaagccacctgtggtggacaggtccttgaaacctggagcactgagcaactcagaaagtattcccacaatcgatggattgcgccatgtggtggtgcctgggcggctgtgcccacagtttctccagttagccagtgccaacactgcccggggagtggagacatgtggaattctctgtggaaaactgatgaggaatgaatttaccattacccatgttctcatccccaagcaaagtgctgggtctgattactgcaacacagagaacgaagaagaacttttcctcatacaggatcagcagggcctcatcacactgggctggattcatactcaccccacacagaccgcgtttctctccagtgtcgacctacacactcactgctcttaccagatgatgttgccagagtcagtagccattgtttgctcccccaagttccaggaaactggattctttaaactaactgaccatggactagaggagatttcttcctgtcgccagaaaggatttcatccacacagcaaggatccacctctgttctgtagctgcagccacgtgactgttgtggacagagcagtgaccatcacagaccttcgatgagcgtttgagtccaacaccttccaagaacaacaaaaccatatcagtctcaccaagatggaggaacagagcccatggcccacttactacatggattcccactttacagtggagaaggagcttgcagtaaccacaaaagtttctgtataagcaaatttagggaattgaacttcagacagtgtggttgtctccttacttatgaacttgggaatacttacttaggtaacaactaacatcagaggtttttgatctgtagcctttctttctgtccataattagctaatagcttctgctgtacaaacacaaaccattccctgtccaagaaaatta

SEQ ID NO: 30036 - DNA, 583 bp, Homo sapiens
gggaaaggtggggaagggtcccgggaacgtggtggggcagggcctccgagcgtggttggactttgaaggggatcggccgccaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatg

SEQ ID NO: 30037 - DNA, 1156 bp, Homo sapiens
gcggggaaaggtggggaagggtcccgggaacgtggtggggcagggcctccgagcgtggttggactttgaaggggatcggccgccatgctgcatcccctttttggaattgctcaaccaggtggtaaccggcgccgcttcctggccttgggaggtggttcctttcttaacccacaagaacctctcccaagagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatgccttcgaggagatgatccggaaccaggagctagaaaaagagcgactgaaaattgtacaggagtttgggaaggtagaccctggcctaggtggcccgctagtgcctgacttggagaagccctccttagatgtgttccccaccttaacagtctcatccatacagccttcagactgtcacacaactgtaaggccagctaagccacctgtggtggacaggtccttgaaacctggagcactgagcaactcagaaagtattcccacaatcgatggattgcgccatgtggtggtgcctgggcggctgtgcccacagtttctccagttagccagtgccaacactgcccggggagtggagacatgtggaattctctgtggaaaactgatgaggaatgaatttaccattacccatgttctcatccccaagcaaagtgctgggtctgattactgcaacacagagaacgaagaagaa

SEQ ID NO: 30038 - DNA, 560 bp, Homo sapiens
ggaacctccgggtgtcatccgcggggaaagatgctgcatcccctttttggaattgctcaaccaggtggtaaccggcgccgcttcctggccttgggaggtggttcctttcttaacccacaagaacctctcccaagagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggcca

SEQ ID NO: 30039 - DNA, 1097 bp, Homo sapiens
acgtttccggaacctccgggtgtcatccgcggggaaagaacttggtcctgatgtctgaccatggagatgtgagcctcccgcccgaagaccgggtgagggctctctcccagctgggtagtgcggtagaggtgaatgaagacattccaccccgtcggtacttccgctctggagttgagattatccgaatggcatccatttactctgaggaaggcaacattgaacatgccttcatcctctataacaagtatatcacgctctttattgagaaactaccaaaacatcgagattacaaatctgctgtcattcctgaaaagaaagacacagtaaagaaattaaaggagattgcatttcccaaagcagaagagctgaaggcagagctgttaaaacgatataccaaagaatatacagaatataatgaagaaaagaagaaggaagcagaggaattggcccggaacatggccatccagcaagagctggaaaaggaaaaacagagggtagcacaacagaagcagcagcaattggaacaggaacagttccatgccttcgaggagatgatccggaaccaggagctagaaaaagagcgactgaaaattgtacaggagtttgggaaggtagaccctggcctaggtggcccgctagtgcctgacttggagaagccctccttagatgtgttccccaccttaacagtctcatccatacagccttcagactgtcacacaactgtaaggccagctaagccacctgtggtggacaggtccttgaaacctggagcactgagcaactcagaaagtattcccacaatcgatggattgcgccatgtggtggtgcctgggcggctgtgcccacagtttctccagttagccagtgccaacactgcccggggagtggagacatgtggaattctctgtggaaaactgatgaggaatgaatttaccattacccatgttctcatccccaagcaaagtgctgggtctgattactgcaacacagagaacgaagaagaacttttcctcatacaggatcagcagggcctcatcacactgggctggattcatgtagaaactttgtggtcactgaagtccttacatgccccatga

SEQ ID NO: 30040 - DNA, 1899 bp, Homo sapiens
atattatctgacctaataagcctggatattttgttagaactggagagcttgggactcctcctttttagcaaaactctgggttagtggtgacagagaaggttggaacacattttaataaccattttttagtgattccttcttatccataaatttccagcagagtatgagttctagagtcaaatgcgaaaggttctagggcagcactgttcaatagaactcctgtgatgatggaagtgttctgtttggcactttccaatatggtatccactagccacatgtggcttctgggtacttaaatgtgactgactagtgtccctgaggtactgaatttctaattttgtttaattttaatcaagttcaaataaccacatgtggctagtggccactatattagaagtgcagtaggggtgagatattttgtttcatatggtcttgttggtctgactgagcaaacaaccttgacgttgattttccagtatttaaaagcattagggaatgaagggatcctgattgtcatggcctgtctctggtaaaatatcagtggatttagaactgctatgttaatcagatcaaggggcttttgccctgatgttatgtatttctctcactgttccatgagtgtccctgtgggcatatcacagtatctagcattttctctgtctgcttgaagactgaaaatgtctaattccagttcaatgtttctccttggaaactaaccttctcttctggctgccacactttttagaacaaatataaagctgaaattctcaaaaaattggagcatcagagattgatagaggcagaaaggaagcggattgctcagatgcgccagcagcagctagaatcggagcagtttctgtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaaatttctgcaactggcagaatctaatacagtgagaggaatagaaacctgtggaatactctgtggaaaactgacacataatgaatttactattacccatgtaattgtgccaaagcagtctgcgggaccagactattgtgacatggagaatgtagaggaattattcaatgttcaggatcaacatgatctcctcactctaggatggatccatacacatcccactcaaactgcatttttatccagcgttgatcttcacactcactgttcctatcaactcatgttgccagaggccattgccattgtttgctcaccaaagcataaagacactggcatcttcaggctcaccaatgctggcatgcttgaggtttctgcttgtaaaaaaaagggctttcatccacacaccaaggagcccaggctgttcagtatatgcaaacatgtgttggtaaaagacataaaaataattgtgttggatctgaggtgatatgttctgaatgtaagcaccgtcaacatcagacacctactcatggacatgtggttgccggattttcttaagatgtttccagaaatgactgatattttatatttatacattttagatgacaaagcttgatatttattgctgttgcacattttaaagttttctttttgggttgctctgtgtcaagagaggttacatggtgttaaatcggtacctgataatgtacccaaatactatggccagataataaattgtgctgcaaacaa

SEQ ID NO: 30041 - DNA, 2208 bp, Homo sapiens
ctcttcatctttgtcatgtgattcaacatattcatgggaataatattccatgacctttgctgtcttctattggttagaagccaactacaggtcttaaacacactcaagtggagaggattacacaaacctacagatatcaaggggcaggaatcacagagctatcttagaattctgcctgttatagttctaaggttgagtttaaatccagactggctctaagtttaacagtccatgcttctaatcagtattatcttctttattcctttgaagaaagcaaacctactttataaccttgcatagagttctaagtaaggtatcccgcagcagattcatactgggtgtcagtcaaatgtgaattattttcacaccttcacttttaaagatcagcttcaggaaactataaccacttgcagttttgtattttcaggaagagatttccaacagtctctctaaacactcaggttatataggttatttcaatttgttcctgtttgtctgaggcagagataaccctggggtttgggatttcaaacttgggtctcaaaaaataactttagttctgcttcttgtttttgaaacagatgaagtgattgagaagaaacagtgaacatcctcatttcacagataagacaacatggatcagccttttactgtgaattctctgaaaaagttagctgctatgcctgaccatacagatgtttccctaagcccagaagagcgagtccgtgccctaagcaagcttggttgtaatatcaccatcagtgaagacatcactccacgacgttactttaggtctggagtagagatggagaggatggcgtctgtgtatttggaagaaggaaatttggaaaatgcctttgttctttataataaatttataaccttatttgtagaaaagcttcctaaccatcgagattaccagcaatgtgcagtacctgaaaagcaggatattatgaagaaactgaaggagattgcattcccaaggacagatgaattgaaaaacgaccttttaaagaaatataacgtagaataccaagaatatttgcaaagcaaaaacaaatataaagctgaaattctcaaaaaattggagcatcagagattgatagaggcagaaaggaagcggattgctcagatgcgccagcagcagctagaatcggagcagtttctgtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaaatttctgcaactggcagaatctaatacagtgagaggaatagaaacctgtggaatactctgtggaaaactgacacataatgaatttactattacccatgtaattgtgccaaagcagtctgcgggaccagactattgtgacatggagaatgtagaggaattattcaatgttcaggatcaacatgatctcctcactctaggatggatccatacacatcccactcaaactgcatttttatccagcgttgatcttcacactcactgttcctatcaactcatgttgccagaggccattgccattgtttgctcaccaaagcataaagacactggcatcttcaggctcaccaatgctggcatgcttgaggtttctgcttgtaaaaaaaagggctttcatccacacaccaaggagcccaggctgttcagtatatgcaaacatgtgttggtaaaagacataaaaataattgtgttggatctgaggtgatatgttctgaatgtaagcaccgtcaacatcagacacctactcatggacatgtggttgccggattttcttaagatgtttccagaaatgactgatattttatatttatacattttagatgacaaagcttgatatttattgctgttgcacattttaaagttttctttttgggttgctctgtgtcaagagaggttacatggtgttaaatcggtacctgataatgtacccaaatactatggccagataataaattgtgctgcaaacaa

SEQ ID NO: 30042 - DNA, 2532 bp, Homo sapiens
taacatccaggagatattctaatacttcttattttccaagtacacacaaattgggggtagggggaagggctaagatgcttaatagtgggcgtagccagttgtggataaatatcaaaaagggaatcctaacatgaagtataagtgggattttcaccaaaaccctatccttccccagactccagtgacagtttaacggtcagctgcatcaaggcttgtgtactgtgcagtcttaaaaggcaccactcctgtccatctcggtgaaattgatggtggagcaaaagggagtttaggtggttccggtctggggagaagacgtgcagggtttcagatgcgaaagtcgcacccaaccgcttcactcgggctctaggccatccgcaggggccctgcttccttccacctgcgagctttttctgcagaatgcgggaagccgccgccgccgccacagaggagggggcggaggcagaggcggaggcggcacccaggggccggggcaggggaggccgggaccatcgcagtgacaatttattttcctgcagcagcggcagcagggacggttgctgcaggttcggggtcggccggcctgcgcgtgggcttgcgaggacgctgttcgtcccctgcgctggggtgtccgacagcgaggaggagaacgacgcacggagcccgcgcgactggaaccagcaaagctccatctgtcggcagaggagaagggggaggaggcacggccgaggcaaacgagcggacgcctcgtcgccgggtgccggtatcaccccgctgcaacgccttccagcaaaagccaccgcggcccgggttgcagcagccggacggatgccaaggccacacggcagccacgggggcagccgtcgcagtcgccgtcccacacgggctgcggacaccaagggttgctaatgaagtgattgagaagaaacagtgaacatcctcatttcacagataagacaacatggatcagccttttactgtgaattctctgaaaaagttagctgctatgcctgaccatacagatgtttccctaagcccagaagagcgagtccgtgccctaagcaagcttggttgtaatatcaccatcagtgaagacatcactccacgacgttactttaggtctggagtagagatggagaggatggcgtctgtgtatttggaagaaggaaatttggaaaatgcctttgttctttataataaatttataaccttatttgtagaaaagcttcctaaccatcgagattaccagcaatgtgcagtacctgaaaagcaggatattatgaagaaactgaaggagattgcattcccaaggacagatgaattgaaaaacgaccttttaaagaaatataacgtagaataccaagaatatttgcaaagcaaaaacaaatataaagctgaaattctcaaaaaattggagcatcagagattgatagaggcagaaaggaagcggattgctcagatgcgccagcagcagctagaatcggagcagtttctgtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaaatttctgcaactggcagaatctaatacagtgagaggaatagaaacctgtggaatactctgtggaaaactgacacataatgaatttactattacccatgtaattgtgccaaagcagtctgcgggaccagactattgtgacatggagaatgtagaggaattattcaatgttcaggatcaacatgatctcctcactctaggatggatccatacacatcccactcaaactgcatttttatccagcgttgatcttcacactcactgttcctatcaactcatgttgccagaggccattgccattgtttgctcaccaaagcataaagacactggcatcttcaggctcaccaatgctggcatgcttgaggtttctgcttgtaaaaaaaagggctttcatccacacaccaaggagcccaggctgttcagtatatgcaaacatgtgttggtaaaagacataaaaataattgtgttggatctgaggtgatatgttctgaatgtaagcaccgtcaacatcagacacctactcatggacatgtggttgccggattttcttaagatgtttccagaaatgactgatattttatatttatacattttagatgacaaagcttgatatttattgctgttgcacattttaaagttttctttttgggttgctctgtgtcaagagaggttacatggtgttaaatcggtacctgataatgtacccaaatactatggccagataataaattgtgctgcaaacaa

SEQ ID NO: 30043 - DNA, 4184 bp, Homo sapiens
taacatccaggagatattctaatacttcttattttccaagtacacacaaattgggggtagggggaagggctaagatgcttaatagtgggcgtagccagttgtggataaatatcaaaaagggaatcctaacatgaagtataagtgggattttcaccaaaaccctatccttccccagactccagtgacagtttaacggtcagctgcatcaaggcttgtgtactgtgcagtcttaaaaggcaccactcctgtccatctcggtgaaattgatggtggagcaaaagggagtttaggtggttccggtctggggagaagacgtgcagggtttcagatgcgaaagtcgcacccaaccgcttcactcgggctctaggccatccgcaggggccctgcttccttccacctgcgagctttttctgcagaatgcgggaagccgccgccgccgccacagaggagggggcggaggcagaggcggaggcggcacccaggggccggggcaggggaggccgggaccatcgcagtgacaatttattttcctgcagcagcggcagcagggacggttgctgcaggttcggggtcggccggcctgcgcgtgggcttgcgaggacgctgttcgtcccctgcgctggggtgtccgacagcgaggaggagaacgacgcacggagcccgcgcgactggaaccagcaaagctccatctgtcggcagaggagaagggggaggaggcacggccgaggcaaacgagcggacgcctcgtcgccgggtgccggtatcaccccgctgcaacgccttccagcaaaagccaccgcggcccgggttgcagcagccggacggatgccaaggccacacggcagccacgggggcagccgtcgcagtcgccgtcccacacgggctgcggacaccaagggttgctaatgaagtgattgagaagaaacagtgaacatcctcatttcacagataagacaacatggatcagccttttactgtgaattctctgaaaaagttagctgctatgcctgaccatacagatgtttccctaagcccagaagagcgagtccgtgccctaagcaagcttggttgtaatatcaccatcagtgaagacatcactccacgacgttactttaggtctggagtagagatggagaggatggcgtctgtgtatttggaagaaggaaatttggaaaatgcctttgttctttataataaatttataaccttatttgtagaaaagcttcctaaccatcgagattaccagcaatgtgcagtacctgaaaagcaggatattatgaagaaactgaaggagattgcattcccaaggacagatgaattgaaaaacgaccttttaaagaaatataacgtagaataccaagaatatttgcaaagcaaaaacaaatataaagctgaaattctcaaaaaattggagcatcagagattgatagaggcagaaaggaagcggattgctcagatgcgccagcagcagctagaatcggagcagtttctgtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaaatttctgcaactggcagaatctaatacagtgagaggaatagaaacctgtggaatactctgtggaaaactgacacataatgaatttactattacccatgtaattgtgccaaagcagtctgcgggaccagactattgtgacatggagaatgtagaggaattattcaatgttcaggatcaacatgatctcctcactctaggatggatccatacacatcccactcaaactgcatttttatccagcgttgatcttcacactcactgttcctatcaactcatgttgccagaggccattgccattgtttgctcaccaaagcataaagacactggcatcttcaggctcaccaatgctggcatgcttgaggtttctgcttgtaaaaaaaagggctttcatccacacaccaaggagcccaggctgttcagtattcagaaattcctttctgggataatttctggcactgctttggagatggagcccctgaaaattggctatggaccaaatggattcccactcttggggatctctaggtcatcatcaccatctgaacagctctgagagagacaagaagtggaatggagaaggtgattaggtaatccaagaattgccaggcgaacaattgtgaaaatctttcatagagttcccgatgaaaacaactctttcttgttagccattatctctgcctttcctttctaaagaaaaacacgtcatttcatcttgattatcagtttctcaagtactcatggatgtgaggccaggtaccctgtcaccttggctctgtttgggatgcaatgttgtgtttgtcaccacttcccattccccaaaagcatctttaacatagaccattcattcttcagattcaaaatgcttaagctgaactaacctcaaagggccctcattaatttacagacatttgaataacacccatattcatttctgctactgaaccaaagccttttccaaaaaaatcatctagcaaactgtttttgccaggccaaatattaacaggtatatatatttgcatacataaatatttacctctatgtcttgtgtgtttttgttatgagacagagtctcactctgtcgcccaggctggagtgcagtggcacagtctcagctcactgcaacctccacctcccaggttcaagcgattctcatgcctcagcctcccgagtagcgaggactacaggcgtgcaccaccacgcccagctaatttttgtatttttagtagagatggggttttaccctgttggccagggtggtctcgaattcctgacctctgatgatctacccgcctggacctctcaaagtgctgggattacagacatgagccactgtgccctgcctctgttttgtgtatttacataaatacatgtctccagagctttaaattcttcttaaattttaaaactagaactaaaccagacattgagaggacccagaaatataccctgactaacgtgggtggaatttcatttggcttgactctttggtgaaaaaaaaaaaaatcaggctctcaaggactcaatttggtgaaccaatgccaaatagaaaaatgttcttgacattttccccaaaatagatgtctaaagattttgcacttcaaattggtactttatgtattaaaagtgatattgaaactaaattcctacccaattagttgaaaaatatgaaaaaagcaattgctagagaatgcaatttattaaatgttggtggtcttttaaaaaatgaattcctcttgtagccagtgagatcagttatttatttatttattttaatagtaacaaggtctcactatattgtccaggctgatcttgaactcctggcctcaagctgtcctcccatctcagcttcccaaagtgctgagattataggcatgagccaccatgcctggctagttaatggttattaagtaatacaaacatttctgtgaattccaccagatcattgactttggcatagttcacttaagactttgtttgataaaataaatctctttcactctaattaggaagcatttttgggatcctgattaatgctctaatattgtggggccaaaaaatatgtggaacgtggccctgcagttagatgagctgagatcactatagtactatatagcgctctaaatcctaaatgctagatcactgtaatactgtacagatcagccacttgctggcttgtgactctgggccatttacttcacctctcaaaaggcatatttaaagtgaggaaaataataagtttattttggaaattcagttagatgatgcaaattgtttactgtaatttctagcatgtagttcgtgctccatgcatttaactgttattacaggttgtattagtatcacattaaattacccactgaagtgaaagtgaaaccagaatgctgtcaacgatt

SEQ ID NO: 30044 - DNA, 3312 bp, Homo sapiens
agccgggccccgcccgccgcagcgcggggctcctgcgtcccgagtgcgcggcggccggaccgggcgggcggagccgggcccgcggggctgctgcggggcgatcgggccgggccgctgccgcgccatggactcccgtgtccagcctgagttccagcctcactgagtggccacccccaaagtgctgccagccgaggaagcccccagcactgaccatgtctattatggaccacagccccaccacgggcgtggtcacagtcatcgtcatcctcattgccatcgcggccctgggggccttgatcctgggctgctggtgctacctgcggctgcagcgcatcagccagtcagaggacgaggagagcatcgtgggggatggggagaccaaggaacccttcctgctggtgcagtattcggccaagggaccgtgcgtggagagaaaggccaagctgatgactcccaacggcccggaagtccacggctgagccaggatgcaaggctcctggtcctgtttgcagccggccaagaggcgctgggaggggcaaaaccatacggatgcgctgctgtctgagaggaagggctgacacttgctggcatggcctctgcgggcttcgtcatcgcatgcactgatgcccggggacctggctgtcctgggcttcccctcggcctccaggtgaggctgcccattgcaggcactgggcaggcctgaccttgctggggctcatggccctgtagcgcttttgttacttgaatgtctagctgagcctgtttttgatggagctactactgtaatgcgtgaactaacaaacctgtgaactgtaaataggcccctggaagcacgtgcttaagcccttttgctgatttttaaaaatatcatctagcgcacacgggactggtattctggctgtactaatgacaagctgagtcaagaccctggagggtcataggcttgtaaaggcccacgccacactcggcaggggtctctcatgtgtgtccatctgcgtgtatgtcaaggaagtgagatgccaatttggggtcttgaggctgaccagttggggtgcttgggtgatctctgcttcattagtcatgggtggaagaaaaaccacaccccccgcacccctccgttctttctgcatagactcacttgttaaatagcagttctgttgagagtggagttactgcagggaagctaccggacctgcctgggagccagtgaagggcgagtcagggcacgcgtcctggaggctgccagcgtccttgtagcagagcagtttcttgccgcttgggtcttcagcacgccaagccccccaccaaccctccaccccgagtgaaggcttcgctgaaattgctttggtcctcatagagcctgtggtggctacttttggtctgaaacccacttggcccaggaaagagaaaaggttgtatgttttgtgttggtgtttcctattttctgcactggaggggaggggactgttgaggttctgtcttttttcttcttttcctcttccctcttcacatcacttggcttcctttcctctctgatgaccgtccgcctatggggttctgacttcactttcctcagcgggtctccagtcccctgacccagctctaaaggcacttaggacccagggaacatttctcacgtgcacattcccctaagagccaccagactgcttcctgccagcctgtgcttgcggcagggagccggggcagggcagaggtgaacttgaagttcaggacttgactctcccacaggtggtgagctggtggctctctggtgagctagtgtctccacagcctgtctccaaggcctcccctatgtacatttcagtgagctcactttgatttttaatcccaccacaagcacatactaattttatttatgattcaaatgtgactcgtgcctgcccatccctgtaatagatggaaggtcagccccggcttaaccacagagcactggcccttcatggctgagctcagagctctggcctcctgctcagactaaaggcacctcctctggcctcacccaagcctcttctaaaaaccatgttgaatgaatccacgttctggaaccccgaggcgggagaagtagggagctgttcgtttaagcagcatacacctaaattgggggtttaaacattaagtaggagcttggggtggaagagggacagccggctgggccacctgagcagaaggtggtaatgaaacacctcagctgggctcttgggagaccttaggaagcaggagaggcaacacctctggctactgatggtgtggcaagttcagaagaggtggtggtggggtaggcgtgatgtcagcagaagccctgcaggctgggtgggcaggacacgtggtgggggccactgaaaccaggcctaggagggagaacaagttccaaaggtgccgactggaagaagggggtaaaagtttgctttggtgagtgagaaaaggctggggcgtgtgatccatcccctcacgtttcagaacttccaggctttctacctcgactctcaccacagccagcacatacacctaggctgtttttccttcctccacacctgagggacgcagcaacagctaggatctgcattttcaggttccgagcctgacccctggaactgaccagcgctcgattgtcagccttggcctggggttttgaccttgccagtgaagtttcggttttgaagtgattaaatgtcacttcctcatcagtttcacttctggaggttttcttatcctactccctggtgccagggacgtacctgggagtttgaatcaggcccatttgagcgtggcagccgtgttgggtgaaggtccggggctcggtgaggcactgggggggttttcgggaggaaaatgaaaatgcttctagaatgagtgaaccacatcatagctctcactgttttttcaatagctactttttttagcagacaccagagccacactcaaatggctaagtaggttatgacctctctggattatttttgaatgcccaactgttgcattcaagttttctgactaataagaaattaagcattcatccttcgtatcactgcagaagcaacagtgggggcacagggagggaactcttgacactgagccactaaaatatggactaattttttggacaaatcttcaaacggactgtgctactgtatttgtctcaaagctaccaagtttgtgcaataagtggaagggatgtcatccttcttcaataaatgctgaatgacattcaagctgattttctagaccactgagaaaatctttatttacaataaatttcaataaaatttgcataaatatattcccaatgtacaa

SEQ ID NO: 30045 - DNA, 3883 bp, Homo sapiens
cagtttgcaaaagccagaggtgcaagaagcagcgactgcagcagcagcagcagcagcggcggtggcagcagcagcagcagcggcggcagcagcagcagcagcggaggcaccggtggcagcagcagcatcaccagcaacaacaacaaaaaaaaatcctcatcaaatcctcacctaagctttcagtgtatccagatccacatcttcactcaagccaggagagggaaagaggaaaggggggcaggaaaaaaaaaaaacccaacaacttagcggaaacttctcagagaatgctccaaaactcagcagtgcttctggtgctggtgatcagtgcttctgcaacccatgaggcggagcagaatgactctgtgagccccaggaaatcccgagtggcggctcaaaactcagctgaagtggttcgttgcctcaacagtgctctacaggtcggctgcggggcttttgcatgcctggaaaactccacctgtgacacagatgggatgtatgacatctgtaaatccttcttgtacagcgctgctaaatttgacactcagggaaaagcattcgtcaaagagagcttaaaatgcatcgccaacggggtcacctccaaggtcttcctcgccattcggaggtgctccactttccaaaggatgattgctgaggtgcaggaagagtgctacagcaagctgaatgtgtgcagcatcgccaagcggaaccctgaagccatcactgaggtcgtccagctgcccaatcacttctccaacagatactataacagacttgtccgaagcctgctggaatgtgatgaagacacagtcagcacaatcagagacagcctgatggagaaaattgggcctaacatggccagcctcttccacatcctgcagacagaccactgtgcccaaacacacccacgagctgacttcaacaggagacgcaccaatgagccgcagaagctgaaagtcctcctcaggaacctccgaggtgaggaggactctccctcccacatcaaacgcacatcccatgagagtgcataaccagggagaggttattcacaacctcaccaaactagtatcattttaggggtgttgacacaccagttttgagtgtactgtgcctggtttgatttttttaaagtagttcctattttctatcccccttaaagaaaattgcatgaaactaggcttctgtaatcaatatcccaacattctgcaatggcagcattcccaccaacaaaatccatgtgaccattctgcctctcctcaggagaaagtaccctcttttaccaacttcctctgccatgtttttcccctgctcccctgagaccacccccaaacacaaaacattcatgtaactctccagccattgtaatttgaagatgtggatccctttagaacggttgccccagtagagttagctgataaggaaactttatttaaatgcatgtcttaaatgctcataaagatgttaaatggaattcgtgttatgaatctgtgctggccatggacgaatatgaatgtcacatttgaattcttgatctctaatgagctagtgtcttatggtcttgatcctccaatgtctaattttctttccgacacatttaccaaattgcttgagcctggctgtccaaccagactttgagcctgcatcttcttgcatctaatgaaaaacaaaaagctaacatctttacgtactgtaactgctcagagctttaaaagtatctttaacaattgtcttaaaaccagagaatcttaaggtctaactgtggaatataaatagctgaaaactaatgtactgtacataaattccagaggactctgcttaaacaaagcagtatataataactttattgcatatagatttagttttgtaacttagctttatttttcttttcctgggaatggaataactatctcacttccagatatccacataaatgctccttgtggccttttttataactaagggggtagaagtagttttaattcaacatcaaaacttaagatgggcctgtatgagacaggaaaaaccaacaggtttatctgaaggaccccaggtaagatgttaatctcccagcccacctcaacccagaggctactcttgacttagacctatactgaaagatctctgtcacatccaactggaaattccaggaaccaaaaagagcatccctatgggcttggaccacttacagtgtgataaggcctactatacattaggaagtggcagttctttactcgtcccctttcatcggtgcctggtactctggcaaatgatgatggggtgggagactttccattaaatcaatcaggaatgagtcaatcagcctttaggtctttagtccgggggacttggggctgagagagtataaataaccctgggctgtccagccttaatagacttctcttacattttcgtcctgtagcacgctgcctgccaaagtagtcctggcagctggaccatctctgtaggatcgtaaaaaaatagaaaaaaagaaaaaaaaaagaaagaaagagggaaaaagagctggtggtttgatcatttctgccatgatgtttacaagatggcgaccaccaaagtcaaacgactaacctatctatgaacaacagtagtttctcagggtcactgtccttgaacccaacagtcccttatgagcgtcactgcccaccaaaggtcaatgtcaagagaggaagagagggaggaggggtaggactgcaggggccactccaaactcgcttaggtagaaactattggtgcttgactctcactaggctaaactcaagatttgaccaaatcgagtgatagggatcctggtgggaggagagagggcacatctccagaaaaatgaaaagcaatacaactttaccataaagcctttaaaaccagtaacgtgctgctcaaggaccaagagcaattgcagcagacccagcagcagcagcagcagcacaaacattgctgcctttgtccccacacagcctctaagcgtgctgacatcagattgttaagggcatttttatactcagaactgtcccatccccaggtccccaaacttatggacactgccttagcctcttggaaatcaggtagaccatattctaagttagactcttcccctccctcccacacttcccacccccaggcaaggctgacttctctgaatcagaaaagctattaaagtttgtgtgttgtgtccattttgcaaacccaactaagccaggaccccaatgcgacaagtagttcatgagtattcctagcaaatttctctctttcttcagttcagtagatttccttttttcttttctttttttttttttttttttttggctgtgacctcttcaaaccgtggtacccccccttttctccccacgatgatatctatatatgtatctacaatacatatatctacacatacagaaagaagcagttctcacaatgttgctagttttttgcttctctttcccccaccctactccctccaattcccccttaaacttccaaagcttcgtcttgtgtttgctgcagagtgattcgggggctgacctagaccagtttgcatgattcttctcttgtgatttggttgcactttagacatttttgtgccattatatttgcattatgtatttataatttaaatgatatttaggtttttggctgagtactggaataaacagtgagcatatctggtatatgtcattatttattgttaaattacatttttaagctccatgtgcatataaaggttatgaaacatatcatggtaatgacagatgcaagttattttatttgcttatttttataattaaagatgccatagcataatatgaagcctttggtgaattccttctaagataaaaataataataaagtgttacgttttattggtttcccccca

SEQ ID NO: 30046 - DNA, 1748 bp, Homo sapiens
aataaatgtgcttcatgcctgatggcaataaactgccagtgtaatccaatagccttaggcagtggagctcctttgtttaataaattgcatgcaactaaacgaagaagctggacgctctgctgagggtatttcattgcataagcctagcctgattgcctgaaatctggcacgtaccctcttggagggggaggggtgagaggggaggaaaggcttgaatgttggcatgcttcaaagcgctctctatactttccagaagctgatctaagctgaagtggttcgttgcctcaacagtgctctacaggtcggctgcggggcttttgcatgcctggaaaactccacctgtgacacagatgggatgtatgacatctgtaaatccttcttgtacagcgctgctaaatttgacactcagggaaaagcattcgtcaaagagagcttaaaatgcatcgccaacggggtcacctccaaggtcttcctcgccattcggaggtgctccactttccaaaggatgattgctgaggtgcaggaagagtgctacagcaagctgaatgtgtgcagcatcgccaagcggaaccctgaagccatcactgaggtcgtccagctgcccaatcacttctccaacagatactataacagacttgtccgaagcctgctggaatgtgatgaagacacagtcagcacaatcagagacagcctgatggagaaaattgggcctaacatggccagcctcttccacatcctgcagacagaccactgtgcccaaacacacccacgagctgacttcaacaggagacgcaccaatgagccgcagaagctgaaagtcctcctcaggaacctccgaggtgaggaggactctccctcccacatcaaacgcacatcccatgagagtgcataaccagggagaggttattcacaacctcaccaaactagtatcattttaggggtgttgacacaccagttttgagtgtactgtgcctggtttgatttttttaaagtagttcctattttctatcccccttaaagaaaattgcatgaaactaggcttctgtaatcaatatcccaacattctgcaatggcagcattcccaccaacaaaatccatgtgaccattctgcctctcctcaggagaaagtaccctcttttaccaacttcctctgccatgtttttcccctgctcccctgagaccacccccaaacacaaaacattcatgtaactctccagccattgtaatttgaagatgtggatccctttagaacggttgccccagtagagttagctgataaggaaactttatttaaatgcatgtcttaaatgctcataaagatgttaaatggaattcgtgttatgaatctgtgctggccatggacgaatatgaatgtcacatttgaattcttgatctctaatgagctagtgtcttatggtcttgatcctccaatgtctaattttctttccgacacatttaccaaattgcttgagcctggctgtccaaccagactttgagcctgcatcttcttgcatctaatgaaaaacaaaaagctaacatctttacgtactgtaactgctcagagctttaaaagtatctttaacaattgtcttaaaaccagagaatcttaaggtctaactgtggaatataaatagctgaaaactaatgtactgtacataaattccagaggactctgcttaaacaaagcagtatataataactttattgcatatagatttagttttgtaacttagctttatttttctttt

SEQ ID NO: 30047 - DNA, 1734 bp, Homo sapiens
agtttgcaaaagccagaggtgcaagaagcagcgactgcagcagcagcagcagcagcggcggtggcagcagcagcagcagcggcggcagcagcagcagcagcggaggcaccggtggcagcagcagcatcaccagcaacaacaacaaaaaaaaatcctcatcaaatcctcacctaagctttcagtgtatccagatccacatcttcactcaagccaggagagggaaagaggaaagggcggctcaaaactcagctgaagtggttcgttgcctcaacagtgctctacaggtcggctgcggggcttttgcatgcctggaaaactccacctgtgacacagatgggatgtatgacatctgtaaatccttcttgtacagcgctgctaaatttgacactcagggaaaagcattcgtcaaagagagcttaaaatgcatcgccaacggggtcacctccaaggtcttcctcgccattcggaggtgctccactttccaaaggatgattgctgaggtgcaggaagagtgctacagcaagctgaatgtgtgcagcatcgccaagcggaaccctgaagccatcactgaggtcgtccagctgcccaatcacttctccaacagatactataacagacttgtccgaagcctgctggaatgtgatgaagacacagtcagcacaatcagagacagcctgatggagaaaattgggcctaacatggccagcctcttccacatcctgcagacagaccactgtgcccaaacacacccacgagctgacttcaacaggagacgcaccaatgagccgcagaagctgaaagtcctcctcaggaacctccgaggtgaggaggactctccctcccacatcaaacgcacatcccatgagagtgcataaccagggagaggttattcacaacctcaccaaactagtatcattttaggggtgttgacacaccagttttgagtgtactgtgcctggtttgatttttttaaagtagttcctattttctatcccccttaaagaaaattgcatgaaactaggcttctgtaatcaatatcccaacattctgcaatggcagcattcccaccaacaaaatccatgtgaccattctgcctctcctcaggagaaagtaccctcttttaccaacttcctctgccatgtttttcccctgctcccctgagaccacccccaaacacaaaacattcatgtaactctccagccattgtaatttgaagatgtggatccctttagaacggttgccccagtagagttagctgataaggaaactttatttaaatgcatgtcttaaatgctcataaagatgttaaatggaattcgtgttatgaatctgtgctggccatggacgaatatgaatgtcacatttgaattcttgatctctaatgagctagtgtcttatggtcttgatcctccaatgtctaattttctttccgacacatttaccaaattgcttgagcctggctgtccaaccagactttgagcctgcatcttcttgcatctaatgaaaaacaaaaagctaacatctttacgtactgtaactgctcagagctttaaaagtatctttaacaattgtcttaaaaccagagaatcttaaggtctaactgtggaatataaatagctgaaaactaatgtactgtacataaattccagaggactctgcttaaacaaagcagtatataataactttattgcatatagatttagttttgtaacttagctttatttttcttttcct

SEQ ID NO: 30048 - DNA, 3476 bp, Homo sapiens
ggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgactgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagcccttattgatca

SEQ ID NO: 30049 - DNA, 3429 bp, Homo sapiens
tctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgactgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagcccttattg

SEQ ID NO: 30050 - DNA, 1728 bp, Homo sapiens
gtgtgcgtcgacgtcagcgtgctgacgtcacgggccggaggtcccggggctgctgggtgcgggcggtgggctgcgcgttgtccgctggactgggtcccggtcacgccccgccaagccccgcccctcaggccggggcgcgaccgcggatccgcagttcccgggccagcctggggcggccggccaggaaccacccgttaaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttgcgttcagccaatttcaattaaaatgaactaaattata

SEQ ID NO: 30051 - DNA, 1365 bp, Homo sapiens
ccggggcgcgaccgcggatccgcagttcccgggccagcctggggcggccggccaggaaccacccgttaagatggaatcactgaattcatcacttgacacagtactagtttggataagtttagcaaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagtttt

SEQ ID NO: 30052 - DNA, 857 bp, Homo sapiens
cggccggccaggaaccacccgttaagatggatccatgtaggccccaccgtttttgcctgtaaaaagagtcagaaagatcaggctggcaaagtcaattgcctccaggctaggtgaagattgaggccaactggagagtgcgtgccccactgaaagtggtcagcagcttggctttattatcatggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggt

SEQ ID NO: 30053 - DNA, 784 bp, Homo sapiens
ttcccgggccagcctggggcggccggccaggaaccacccgttaagaattaactcctagaattctgacaggcggtagtgctttgcaagctttgtgttaagagctgctactggggaatatgttgttgctgtaccttccactagggtggcattgatctcattaagacagaaattatgtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgctgcccatcatttcattcatccttgcctggattgagacgtggttcctggatttcaaagtgttacctcaagaagcagaagaagaaaaca

SEQ ID NO: 30054 - DNA, 859 bp, Homo sapiens
tggggcggccggccaggaaccacccgttaagggtcttactctgttgcccaggctggagtgcagtggcaccatctcagctcactggagcgtctgcctccaggttcaagtgattctcctgcctcagcatcccaagtagctgggactacaggtgtgcactaccactcctgtctaatgtttgtattttttggtagagacagggtttccctatgttggccagtctggtcttgaactgctggcctcaagtgatctgcccgcctcggcctcctaaagtgctgggattacaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgctgcccatcatttcattcatccttgcctggattgagacgtggttcctggatt

SEQ ID NO: 30055 - DNA, 1664 bp, Homo sapiens
tcacgggccggaggtcccggggctgctgggtgcgggcggtgggctgcgcgttgtccgctggactgggtcccggtcacgccccgccaagccccgcccctcaggccggggcgcgaccgcggatccgcagttcccgggccagcctggggcggccggccaggaaccacccgttaaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtgaatggaggcattgagaacacattagagaaggaggtgatgcagtatgactactattcttcatattttgatatatttcttctggcagtttttcgatttaaagtgttaatacttgcatatgctgtgtgcagactgcgccattggtgggcaatagcgttgacaacggcagtgaccagtgcctttttactagcaaaagtgatcctttcgaagcttttctctcaaggggcttttggctatgtgctgcccatcatttcattcatccttgcctggattgagacgtggttcctggatttcaaagtgttacctcaagaagcagaagaagaaaacagactcctgatagttcaggatgcttcagagagggcagcacttatacctggtggtctttctgatggtcagttttattcccctcctgaatccgaagcaggatctgaagaagctgaagaaaaacaggacagtgagaaaccacttttagaactatgagtactacttttgttaaatgtgaaaaaccctcacagaaagtcatcgaggcaaaaagaggcaggcagtggagtctccctgtcgacagtaaagttgaaatggtgacgtccactgctggctttattgaacagctaataaagatttatttattgtaatacctcacagacgttgtaccatatccatgcacatttagttgcctgcctgtggctggtaaggtaatgtcatgattcatcctctcttcagtgagactgagcctgatgtgttaacaaataggtgaagaaagtcttgtgctgtattcctaatcaaaagacttaatatattgaagtaacacttttttagtaagcaagatacctttttatttcaattcacagaatggaatttttttgtttcatgtctcagatttattttgtatttcttttttaacactctacatttcccttgttttttaactcatgcacatgtgctctttgtacagttttaaaaagtgtaataaaatctgacatgtcaatgtggctagttttatttttcttgttttgcattatgtgtatggcctgaagtgttggacttgcaaaaggggaagaaaggaattgcgaatacatgtaaaatgtcaccagacatttgtattatttttatcatgaaatcatgtttttctctgattgttctgaaatgttctaaatactcttattttgaatgcacaaaatgacttaaaccattcatatcatgtttcctttg

SEQ ID NO: 30056 - DNA, 2132 bp, Homo sapiens
ggcggggccgcaggcgaacgcaagtcccgcttcgctctcgggggcggactcagcggcggaagtggcgctgccggaagatcttcttccgctctgaggcgctactgaggccgcggagccggactgcggttggggcgggaagagccggggccgtggctgacatggagcagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcggctccggcactggtgggtgattgcggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgatggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaaaaaa

SEQ ID NO: 30057 - DNA, 1925 bp, Homo sapiens
gaggccgcggagccggactgcggttggggcgggaagagccggggccgtggctgacatggagcagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcggctccggcactggtgggtgattgcgctgctcagcaaaggggcatttggctacctgctccccatcgtctcttttgtcctcgcctggttggagacctggttccttgacttcaaagtcctaccccaggaagctgaagaggagcgatggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggg

SEQ ID NO: 30058 - DNA, 673 bp, Homo sapiens
caggaccagaggctggagctcagggctaggcctgccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcggctccggcactggtgggtgattgcggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgatggtatcttgccgcccaggttgctgttgcccgtggacccctg

SEQ ID NO: 30059 - DNA, 2834 bp, Homo sapiens
gaacgcaagtcccgcttcgctctcgggggcggactcagcggcggaagtggcgctgccggaagatcttcttccgctctgaggcgctactgaggccgcggagccggactgcggttggggcgggaagagccggggccgtggctgacatggagcagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcggctccggcactggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgattctgctcctccagggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaaaaaattccagcccctcccactgccttgcctcttgagggaagagaaaggcaggcagcagcttggatgaagagggaagacccctcacacagcctctcctgggctcacaggagggcggagcccggggagccagttcctgaaacatgccccccattccccccccgcccaccccccactccccgctttcctgaccagttcaactgagcagatgactggtcagaaaaaaatgccccgccccctgccaggcttcagcggggcaagtttaaagtctctagtccaggaatggaggtgggggtatgggcacctggcagtgcccacagcaagccttgactgtgtggcctggagatggggcctgagcttcagggtcactgaggcacctctgggatccaggccacctggagccccggacctcccagactccactcacccattccctctccccgcacggcactcacaccaggggcggcctggagcccggatcgcagggcggggccaggccactgcctgccttcctcctccctcccggctggcctgcccccttgcctgcctgcatgcaggcttccagcagagccagcttcttcagagccaggtggatcctgtttcggtcctgcctaggtgtgtgaccctgggcgaatctacctctctcagcttctgcttcccactttatgaaaatgggactgatgtcacagggttgttatgagattaaaagatatgaagaaccggg

SEQ ID NO: 30060 - DNA, 4606 bp, Homo sapiens
acaagttggctgctgtcgcctgcgcatcggcgggccgggaggctgagcagtactgttgagagcggtgtgaggtgcttggtagcgcgccgtagctgcttccacgtccttgcttcacctcaggtaaagagagaagtaatggaaggcctgtctgatgttgcttcttttgcaactaaacttaaaaacactctcatccagtaccatagcattgaagaagataagtggcgagttgctaagaaaacgaaagatgtaactgtttggagaaaaccctcagaagaatttaatggatatctctacaaagcccaaggtgttatagatgaccttgtctatagtataatagaccatatacgcccagggccttgtcgtttggattgggacagcttgatgacttctttggatattctggagaactttgaagagaattgctgtgtgatgcgttacactactgctggtcagctttggaatataatttccccaagagaatttgttgatttctcctatactgtgggctataaagaagggcttttatcttgtggaataagtcttgactgggatgaaaagagaccagaatttgttcgaggatataaccatccctgtggttggttttgtgttccacttaaagacaacccaaaccagagtcttttgacaggatatattcagacagatctgcgtgggatgattcctcagtctgcggtagatacagccatggcaagcactttaaccaacttctatggtgatttacgaaaagctttatgagaggcaaaatacattcaaacttgtagtactacagatcaactctctcagctacatggcctgtaaaaatcattgattccacttttctgcatagccggtagaaaaatttgaaatgtttttggttcactagtacaatgtttggttttattcctaaagtaaatagctatctaagagagggcattttcacttttttttttttaaattttgagacaggctctcactctgttgcccatgctggagggcagtggtatgatcacagctcactgcagctttgatctgaccgctcaaggggttattctacctcagcctcctgaatagctgggaatacaggtgcacgccactatgcatggctaatttttgtttaattttttgtagagatgtggtcacactgtgttgcccaggctggtcttgaactcctggcctcaagtcattccccaccttagcctcccaaagtgttgggattataagcgtgagccaccatgcctggccccaatttaaaatgtggaattcagttggtgtccaagacttatcttgagactcttaaaagcatcagtctgtaactagaacaaatacagtcttagatttacccaagtgcctagatatcattttataatgattagaattgagtattgtgggtcccctaattctgtgggtgccttaagtgagaatttctaaatgattttcacattctaaatgactttgggttttgaactctccatctagtttacttctaaaatgggaacttgaggcaattcaggtatccaggcaaatctttgtatatatttttttgtgtacatgcacacatctcgaaatccatttccgtgtttaatgttagttgtttatgtgttagtattcctgtgtctactgttttgttgttgttaatatgggtaaagtgagccctgaaatacatgctaaacaagacatgaaatgcagaaaggtacatagtgtttcaagtgcatggtagtttgatctgtgttttactttattgtgttttcttgagtgtaaagaaagaataaatcaaagttcttcatacccattttgacaaagtggaacagtggagctgttttttgcttttgtttttatttattttttgccactggtgatgatagatttcaaaaaacaaaaggtggcagcagcacaatgttcatggtgaattatctcatagtatctagattgatcaagatctgacagaaggaatgcacaaaggattctatattcttaatgatttattaattaccaggatccttttctaaattgaatgtacttttgaattactaggtttcttctttttttttgttctgcaatagtgaaagaaaactcagtagtttagtttcagtttctcatggaaattggtaaatgttagttttgacttcatctattttttatttgtttttattagcgtagagtaggaagtctcatattctactgttctatctaggatggtgaaattccaaaggtgcctaacttgagtaagggatttgtgacaagatagtacacattactataagggctattatttcctgaactggatgtccctaaaagcaaataaactgcccactatctctactctagtgctctctttgtccttatcaacatatacctccaataagtaattacataattcaccgttaaacatggacccactctaggtaaaattaccctcatggaaacattttcactgtgagaatgatgaatttaaaaattatgtttgaatcacctaaaatgtatgtgcagcttctagatggccccttagatctgctgggctctagctgtgtactttaaaaaaacaaaaacagctttattgatatataatttacatattatgtaatttacccacttttaagtatctaattcagtgatgttttaatacatatgtagaactatgcagccatcagcacaatctggatttagaacgtttccatcattccaaaagattccttttgtcttttttgcagactcatacctaacacaaatctaaagtttatcactgttgccaggataattacagcaggttatgtttggtttcatttttaagagtggaggtgttcatgattctaagctcaggaatcttgtgatcatgtattaaatatgttatctcatactataatgataaaaaagcttaatgatgtgggttgggatggatattaacataaataattgagtccgctgcttctatagcaatgctgtaggatagaacaataatgtaagtgatatatgtaattaaaaaattctagaagccacattaaaaaataaaaataaacagctgaagttaattttaatattttatttaactcaatacatccaaaatgttatcattttaacatgtaattgatgtaaagatttattctgatagtttgtactatttcttgtactaattttttgaaatctggtatgcattttacaaatttgggcaagccacattttaagtgctcattagccacatgaggccagtggatactgtattgaatagcacagtcctatagcatatttattaatttgtcttgtagtaagatgaaatagacaataatacggaataatatcttaaatggaaatctttgttagtctctagagccttcattgcttgataaataggacatctaaactttagatataaatcagttgtcaatgagataaaattattgccagcaaatattttccttcaaagataagtaacttttgatatggcagttggtgaaatgaaagaatataatctgccttcttgttaaatggttgactattctgtagcttgtaggtagtacgtattagaaacttgtgtatgtgggaaatatttggcataatactgttttcagtatatagtagctattttttaaggaaattagtttcatacaagaaaaagattattataaaagtgatacttttgcatgaaatattagtttgtgttgataactcttagttaacccttaaagtttaaaacagtactcaaaaaaaaataatgagaatctagtattctgtagttaactaatctataagataaattgctaaagtactagggagcttgtaaatcttaaaaatctttttatttcagtgttcattcaggttggatatatttgaaattgtagatttctatctgtacaacatctcctagttaatagaatttttttccttcccctcccttctctctcctcctccttttctaaccaaagggcattttatcaacaatcatgctgaattcaattaatatctcaagctaaaaaactatgtaattgaggttgtatctggagaagatgggaaaacattgtataatttaagcccttaattgtctgttgagcttttagggctgagtaattgcctttcatacaaataaaagctttaactcttttctcaagagtgtaccaccgtccttagaatcaggtgttttaaatccagtttcttttaattaaatgggactgtagtgatccctaccctgtagagaaatcaacagaactagagaagctaagggcttgatcaggtttcccctagaacctgtgttgcctgcctgctgtatcttccatgtctttcttattcaacttctagaagtagagaaggttgggacttgagtgtagaagaaacatcagaataatttcaaaaaacaggaagttggaactataatttttaaattattgtattgtttttacggattttacatgtatagttaaatattaaaattcatctcttgcagttcaataaaagctatagtatagattttatttttaagaagtttatataattcttttgtgaaccaatatgtaaaactagaatatttattaaactaataatatgtattagtatcaataaaatatgtatttatttttaaattggtatgaaacaaaataaaaatttgtagacactcttaaaa

SEQ ID NO: 30061 - DNA, 803 bp, Homo sapiens
cttgccctgaggcgctgggtgccttccagttggctgcgaccagcggtgacttacaagttggctgctgtcgcctgcgcatcggcgggccgggaggctgagcagtactgttgagagcggtgtgaggtgcttggtagcgcgccgtagctgcttccacgtccttgcttcacctcagagagaagtaatggaaggcctgtctgatgttgcttcttttgcaactaaacttaaaaacactctcatccagtaccatagcattgaagaagataagtggcgagttgctaagaaaacgaaagatgtaactgtttggagaaaaccctcagaagaatttaatggatatctctacaaagcccaaggtgttatagatgaccttgtctatagtataatagaccatatacgcccagggccttgtcgtttggattgggacagcttgatgacttctttggatattctggagaactttgaagagaattgctgtgtgatgcgttacactactgctggtcagctttggaatataatttccccaagagaatttgttgatttctcctatactgtgggctataaagaagggcttttatcttgtggaataagtcttgactgggatgaaaagagaccagaatttgttcgaggatataaccatccctgtggttggttttgtgttccacttaaagacaacccaaaccagagtcttttgacaggatatattcagacagatctgcgtgggatgattcctcagtctgcggtagatacagccatggcaagcactttaaccaacttctatggtgatttacgaaaagctttatgagagg

SEQ ID NO: 30062 - DNA, 4871 bp, Homo sapiens
cgcagctaagcgcagctcccgacgcaatggacccggcgctggcagcccagatgagcgaggctgtggccgagaagatgctccagtaccggcgggacacagcaggctggaagatttgccgggaaggcaatggagtttcagtttcctggaggccatctgtggagtttccagggaacctgtaccgaggagaaggcattgtatatgggacactagaggaggtgtgggactgtgtgaagccagctgttggaggcctacgagtgaagtgggatgagaatgtgaccggttttgaaattatccaaagcatcactgacaccctgtgtgtaagcagaacctccactccctccgctgccatgaagctcatttctcccagagattttgtggacttggtgctagtcaagagatatgaggatgggaccatcagttccaacgccacccatgtggagcatccgttatgtcccccgaagccaggttttgtgagaggatttaaccatccttgtggttgcttctgtgaacctcttccaggggaacccaccaagaccaacctggtcacattcttccataccgacctcagcggttacctcccacagaacgtggtggactccttcttcccccgcagcatgacccggttttatgccaaccttcagaaagcagtgaagcaattccatgagtaatgctatcgttacttcttggcaaagaactcccgtgactcatcgaggagctccagctgttgggacaccaaggagcctgggagcacgcagaggcctgtgttcactctttggaacaagctgatggactgcgcatctctgagaatgccaaccagaggcggcagcccacccttcctgcctcctgccccactcagggttggcgtgtgatgagccattcatgtgttccaaactccatctgcctgttacccaaacacgcctctcctggcagggtagacccaggcctctaaccatctgacagagactcggcctggacaccatgcgatgcactctggcaccaaggctttatgtgcccatcactctcagagaccacgtttccctgactgtcatagagaatcatcatcgccactgaaaaccaggccctgttgccttttaagcatgtaccgctccctcagtcctgtgctgcagccccccaaatatatttttctgatatagaccttgtatatggctttaatgccgcaaaatatttatttttccttaaaaaaggtgtcaacttggaaataatggtttaaaaacaggataagcattaaggaaaaacactttcaatgtgtcttccatttgatgaatttgtttttctctctttatccccgcaaggtggagtttcatgtcctcggtgaaaccagacagtgtgaatctgttccagcccaaatctgcagcattagggatgagttctcagaagtgattctgaactgagcacgcactcatgtctgcatggggaactctggggagaagagccttccttttctttcccttgggcatttgcctttccttgtcgtcttactgaggcggaggcaggaggtctctgtcttccaggccctggccaggccatcctgccatcaggaaagatggaagagtaggcctccgtctagcagccctggctggaaatcccccctctagatcctgctgcaagactgtacaaactcacaggggccatgtccacccaggcacatcatcagaaccagggagcacagccttgccacctagaaggggcctcagcagccgtgcaactttctttccctatctccaatccagagagggatcctctaacattctctagcaacctcatctgcacccccaccaccttccttgtaagaaagaccacgtgtgactaaaatcccttcacgctgcatttacccaggttactattgtgcgcgcaaaatgttttcacagtgttctcagcctttgctcctccaaacagaaaacgtttcccctgcgttactgttacttccctatttttgagtcctggggtgactgtctcttaaatgtgccaagatgtgagcaagctttaaaacatgacagctcagtgttaaggagacagaaagcttcctctttctctgttctattgcaactacaaattctacagtcatgcctaagatcctttagctaacacccttttcaagaaatcatcagactcttggattgacttagaattcattcattcattaagtgcttaccgagtccccgctctgtggcaagcactgttctatatcaacttctcatgagttcagccaattctaggtgcaccagccaaggaaacttcatgcctgccctctctgagctccatactctgaggtggtggtcttatcaagatgggatcgccttgtacatccctgtgtagccaagtggaaggccagccaaccaagaatgcatctcactgggcctatgggacatactgtgcctgcactgctcctccacgtgactgcatcaggttaaactggtcagagccctggatgaggagctggaaaacatgcatccagtccaagctctgccacttgggccaagtgtgctcttgaacagtcacttaatatatctgctttgatttgtcttttaaagaaaatatggaggcaggaataccagtgtcagtgtagcctgcttcttgagtgttggcacaagtgagataatgtatgaatcagtaaaatgctgggcaaagcaaagaagtagggctgcctgggagtggattcctttttatggtgagttaagacgacttcacaattgttagctgtgatgcctgcagtgtttgaggatggcattgccttcatcctgtgtcagctctgaagaagttggcagagcaaagctaagcctcaagtgtaaatcccagcatcatggaacgcaaatggatgagcttttgttttaggatcttcttgctgattcctacccagaggacttccccagcctagagaccagaaacctgggcaatagttatatcttcagtggccctaggagttgttgtgtctccttggggaggagagaaccttctaaaacaggccagagacaggaggtactgggagggccatgggctcacctgcatctatgcccagataacctgggacagataacctctgtcccaatcacttgctttgcctggtctctcaaggagtctcttggtaccccaggcccacggccagctccatgctcatccctgtccccaccttccagtcttgatgaaaacccaccttctctttcatcccttggctgcttgataagacttaaaacaattccctgattttagggaaggccactgcgtgcacagatggtgagtttgtgcaggcaaggaatgtgccctccacatcacgtggcctccttgcccagcctgggtcatgggaagggagtgttgaattgaatcacgtctttcgttggtagattatgttcatcttcaatgtttctattaagtctaaaaagtggatacaaatggtgcctccaagttcttgtctaattgcttgtctactgcttgacaaaatccagaatggaataggccaaacaagttaaccagcaggacagaaactgctctaagcccattattccttgagatgaatagaacagtgagctgaacgcctgctctaatgaagccactaaaggggtttacaggaaggttaggagcccagatgggttttgagtccactgctgggaaacagattcttcacttcctgtggaccctggagaagccatcagattacattaacatggctccactgatgatggcctgagaattactattgtttgtgtttcatctgtgtccttgccaggtcttcccccacatccttacttcacaggatcaggggctgagaggagaccaatactctggcccaggcctggtcaagggatgctggttgttgctgatgcaaagtcacattgcctggtcctgagcttggcaatcaggcatccagagatggccaaaccaaatatccctttggccaggcactcaggcattccctgtaatgttgtgcacttaaagcatcttgggctgatagtctccaccgaatcacagaagaaaactcaatctgccgcatcactcaccagctggataagccatttactgtacacagtgtgtgccctcttatcaatacattggcacagaaccatacaccgtagaagctgctgtgatcactaaaggcaatgcccgtttagccctgagcacagtgcttggcatgtggtaggtaagtagtagcaattttatttgataccctcatatacacgctggttccttctgtcggcacacctgtccacgctttgagcttggtgcttcacctgtactcctctgtttactggctccaccacccttccctaggattacttctccaatccaaccaaaaacaattttgcaaatgtttcatgtgacaaactgtatttttcataaatgaccccagcaatatttcctctccccttaaacccaggcaggtttgtgtcagctctaactgatggagtatggtggaggtgatgccatgcaacttccaaggcaaaggtataaacaagatgcagcttctacatggctcttgcgatcctgggatgctcatcctgggaatccagacaccatgttgtgaggaggcccaggccacaaggagaggccacctataagcattcaggccagcagccccaggtgagttcccagccaacatcaacggccagatgtatgagtgaatgatctcacgtggtcccagcctttgcatgactttgcatgacgccagctgatgccaagtgggacagagatgagctgcccattccaatctctgcccacattgcagattcatgagaaaaataaatgtcactgtttgggggtgaatcatgacacagttacagtacttgaaacattttgcgaagccaggcatgaatgtcatatgaaattctaataaatccattttatttgtggcaccacaa

SEQ ID NO: 30063 - DNA, 761 bp, Homo sapiens
atggacttcaaggcaattgcccaacaaactgcccaagaagttttaggttataatcgagatacatcaggctggaaagtggttaaaacttcaaaaaagataactgtttccagtaaggcttctagaaaattccatggaaatctatatcgtgttgaagggataattccagaatcaccagctaaactatctgatttcctctaccaaactggagacagaattacatgggataaatcattgcaagtgtataatatggtacacaggattgattcggacacattcatatgtcataccattacacaaagttttgccgtgggctccatttcccctcgagactttatcgacttagtgtacatcaagcgctacgaaggaaatatgaacattatcagttctaaaagtgtggattttccagaatatcctccatcttcaaattatatccgcggttataaccatccttgtggctttgtatgttcaccaatggaagaaaacccagcatattccaaactagtgatgtttgtccagacagaaatgagaggaaaattgtccccatcaataattgaaaaaaccatgccttccaacttagtaaacttcatcctcaatgcaaaagatggaataaaggcacacagaactccatcaagacgtggatttcatcataatagtcattcatgataccaaaagaagaaatgaggccgttctgctataaaatcatgtgtagtagttattgctgtttacttctaagtcaacgcacataaataatactgttaaac

SEQ ID NO: 30064 - DNA, 4862 bp, Homo sapiens
ggccttccaggaggcgggaggcgcccgctgtcgaggcagctgagccccggcaaccgctgctctccgcctctcccctcgcggggccggctcatggagcgcagggaccgggctggctctcgccgagccccgggcctcttttagcctcgtccccagagagggaggagccggtgcccggcacagccccgccggccctagaagctccccacgcgccaccatgcctctgctggacgttttctggtcttgcttcaggaaggtgaagtgcttcccattgctgcaggtgaagaagaacgctgaagccgaggccaaaagagcatgtgagtggcttcaagcaacaggattccctcagtatgtgcagctttttgaaggaggctgatgaccttgaataattgtgcctcgatgaaactggaggttcattttcaaagcaagcagaatgaagactcagaagaggaagagcagtgtaccatcagtagccactgggccttccagcaggaaagtaagtgctggtctcctatggggtcctctgatctgttggccccaccgagccctggcctgccagcgacctcaagctgtgagagcgtcctcaccgagcttagtgccacctctctgccagtcatcaccgtgagcctaccacccgagccagcagacttgcccttgccaggccgtgcccccagctcgagtgaccggcccctcctcagccccacccagggccaggagggtccccaggacaaagccaagaagcgccatcgtaaccgtagcttcctcaagcaccttgaatctctgaggcggaaggaaaagagtggcagccagcaagcagagcccaagcatagtccagccacctcagagaaggtctccaaagcctcatctttccgcagttgtcgtggcttcctctcagctggattttacagggccaagaactgggccgccacctcagccggtggcagtggtgccaatactcggaaggcctgggaggcctggcctgtggcctcgttccggcatcctcagtggacacaccggggtgattgcctggtgcacgttcctggggaccacaaaccaggcacattccctcgctccctgtccattgagagcctgtgtcctgaggatggacaccgcctggcagactggcagccaggtaggcggtggggctgtgaggggcgccggggctcctgtggctcaacgggcagccatgccagcacgtatgacaacttgcctgagctgtacccagctgagcctgtaatggttggggctgaggctgaagatgaagatgatgaggagagtgggggcagctatgctcacctagacgacatcctccagcacgtgtgggggctacagcaacgagtagagctgtggtctcgggccatgtacccagacctggggcctggagatgaggaagaggaggaggccacttcatcagtagaaatagccacagttgaggtcaaatgccaagctgaggctctcagccagatggaggttccggcccatggagagtccccagcctgggcccaggctgaagtccagccagcagtcctggctccggctcaggctccagctgaggctgaaccagtggcacaggaagaggctgaggccccggccccagccccggccccggccccagcccaggacagtgagcaggaggcacattcaggcggggaacccacctttgcctctagcctgtctgtggaagaaggacactccatttctgacactgtggcctcctccagcgaacttgacagtagtgggaactccatgaatgaggctgaggctgcggggcccctggctggactccaggcatcaatgccccgtgaacggcgcgattcaggtgttggggcctcacttaccagaccctgcaggaagctccgttggcatagcttccagaactcccatcgtcccagcctcaactcagagtcgctggagatcaaccggcagtttgcaggccagatcaacctcctgcacaagggctcactgctgcggcttaccgcgttcatggagaagtacactgtgccccacaagcagggctgggtctggtcaatgcccaagttcatgaggaggaacaagaccccagattaccggggacagcacgtatttggggtgccacccctcatccacgtgcagcgcacgggccagccactgccacagagcattcagcaagccatgcgctacttgcgcagccagtgcctggaccaagtaggcatcttccgcaagtctggggtcaagtccaggatccagaacctgcgtcaaatgaatgagacctcgcctgacaatgtctgctacgagggccagtcagcctacgacgtggctgacctgctaaagcagtatttccgggacctgcctgagcccatcttcaccagcaagctcaccaccactttcctccagatctaccagctcctccccaaggatcagtggttggcagcagcacaagccgccaccttgctgctccccgatgagaaccgagaggtgctacagaccctgctctacttcttaagtgacattgcctctgccgaggaaaaccagatgacagcaggcaacctggcagtgtgcctggcgccctccatcttccacctcaatgtctctaagaaggatagcccctctcccaggatcaagagcaaacgcagcctcattggcaggccaggccctagggacctgagtgacaacatggcagccacccagggcctgtcgcacatgatcagtgactgcaagaaacttttccaggtgccccaggacatggtgctgcagctgtgcagctcctacagcgcagctgagctcagccctcccggcccagccctggctgagctgcgtcaggcccaagctgcaggggtaagcctgagcctctacatggaagagaatatccaggacctgctgcgtgatgctgctgagcgcttcaagggctggatgagcgtgccagggccccagcacacggagctggcttgcaggaaggcaccggatgggcaccccctgcggctatggaaggcatccacagaggtggcagcccccccagctgtggtgctgcatcgtgttctccgggagcgggccctctgggatgaggatctgctgcgggcccaggtgctggaagccctgatgccgggtgtggagctgtaccactatgtcaccgacagcatggcaccccatccctgccgcgactttgtggtgcttcggatgtggcgctctgacctgcctcgtgggggttgcctgcttgtctcccagtccctggatccggaacaacctgtgccagagtcgggtgtgcgagccctcatgctcacatcccagtacctcatggagccttgcggcttgggccgctctcggctcacacacatctgccgggctgacctcaggggccgttctcctgactggtacaacaaagtctttggacacctgtgtgccatggaagtggcaaagatccgggactccttccccaccctgcaggcagcgggccctgagacaaagctgtgagccttgggctggtcccagggtggcaccacccaggccccctgggcaccaagggagcgagggggaataagagcagggcagccccctgggtgccgctgtcaggagcagagccaggcccaggtggctccagctgcctgtcctgtcccctttcctaaagctcctctgcacatagaggggagaaaaagagaatttaggcaactccactcccccttcacccccaaccctgtattctactctcccgaaaagagaagagaatcgcatgagtagcaagactgctgccaccagccacctgcttgtgaggccgccacttggcatgaagcctccacagctccccgcctgcaggggcaaagaggtcgacagcaatgtgtgatcccagctctctgccagactgagagggcaagccgtcttgtttgctgcaaggatgcttttgaggttggacaggaggttctggtcctgcctttggggccaacgctggctctgaagtgtctttttcagaggaattggactggagtgaatgggcacaggggtggagcgcagggcagccccagtcaccacgagctgtttcatttgtgtaaatacgatgctgaattttatgaggctgagttaagagtgggcactgacgggcccctaatatgtgacatgacgatttggcatagatagggatgtgagagtggagtaccttcctttctcaagtctcgagatgccagtgaaaccagtattccctgacttgggtttcacactttatcgaccaccccatggggtcctgtgtagcctttggccacgcactgacactgcccaggccaagcaaaagcagagtgtggttaagagacaagggtctatgtcatcatcccttttgcttatggtagtgggctaacataacagcccctttctcaagcagagacctggcccctgggccagccagatggaagggcctatcttagccagctggagcttaagccaaacctgttctgtcccactggccagccatctttgctcacatggaaattcaaatgccattcaaaggccactggtgctttatttttctatctgctgagtaaactgaaatgagatgggtcccaaccaccactgtaattttcaagcctattttatttgtacctgtaaatactgtacagctaatatatatatatatatatatatatgtgtgtgtgtgtgtgtgtgtatatgtgtttatagagatacacacacatatatatgtgtgtatatatatacacatacatatatatacacacacgcatttgcacagacacacacatatatcaattctcatgagtgtattataatctctggtgggggcaagtgtctggaaggcctgaggggcacttcagatgagaatggagaggtagggagccaggtgcagcaggatccctcaaatcaataaagcattaccagagatgcacttt

SEQ ID NO: 30065 - DNA, 4820 bp, Homo sapiens
ctcgggttgacaacggctaagcagccgcggcagctgctcttctggctggcaccgtcacccctgcccgaccccaggccccgcgtgtgtcccggacggagcagtccctcctgggctcgcctcctgcccgctcgctctgtgtcagcgcccgaacccaaaggggtggacgcggcctccagaagccgaggccaaaagagcatgtgagtggcttcaagcaacaggattccctcagtatgtgcagctttttgaagaaggttcgtttcccctggatattggctctgtgaagaaaaaccacggttttctggacgaggactctttgggggccctgtgtaggaggctgatgaccttgaataattgtgcctcgatgaaactggaggttcattttcaaagcaagcagaatgaagactcagaagaggaagagcagtgtaccatcagtagccactgggccttccagcaggaaagtaagtgctggtctcctatggggtcctctgatctgttggccccaccgagccctggcctgccagcgacctcaagctgtgagagcgtcctcaccgagcttagtgccacctctctgccagtcatcaccgtgagcctaccacccgagccagcagacttgcccttgccaggccgtgcccccagctcgagtgaccggcccctcctcagccccacccagggccaggagggtccccaggacaaagccaagaagcgccatcgtaaccgtagcttcctcaagcaccttgaatctctgaggcggaaggaaaagagtggcagccagcaagcagagcccaagcatagtccagccacctcagagaaggtctccaaagcctcatctttccgcagttgtcgtggcttcctctcagctggattttacagggccaagaactgggccgccacctcagccggtggcagtggtgccaatactcggaaggcctgggaggcctggcctgtggcctcgttccggcatcctcagtggacacaccggggtgattgcctggtgcacgttcctggggaccacaaaccaggcacattccctcgctccctgtccattgagagcctgtgtcctgaggatggacaccgcctggcagactggcagccaggtaggcggtggggctgtgaggggcgccggggctcctgtggctcaacgggcagccatgccagcacgtatgacaacttgcctgagctgtacccagctgagcctgtaatggttggggctgaggctgaagatgaagatgatgaggagagtgggggcagctatgctcacctagacgacatcctccagcacgtgtgggggctacagcaacgagtagagctgtggtctcgggccatgtacccagacctggggcctggagatgaggaagaggaggaggccacttcatcagtagaaatagccacagttgaggtcaaatgccaagctgaggctctcagccagatggaggttccggcccatggagagtccccagcctgggcccaggctgaagtccagccagcagtcctggctccggctcaggctccagctgaggctgaaccagtggcacaggaagaggctgaggccccggccccagccccggccccggccccagcccaggacagtgagcaggaggcacattcaggcggggaacccacctttgcctctagcctgtctgtggaagaaggacactccatttctgacactgtggcctcctccagcgaacttgacagtagtgggaactccatgaatgaggctgaggctgcggggcccctggctggactccaggcatcaatgccccgtgaacggcgcgattcaggtgttggggcctcacttaccagaccctgcaggaagctccgttggcatagcttccagaactcccatcgtcccagcctcaactcagagtcgctggagatcaaccggcagtttgcaggccagatcaacctcctgcacaagggctcactgctgcggcttaccgcgttcatggagaagtacactgtgccccacaagcagggctgggtctggtcaatgcccaagttcatgaggaggaacaagaccccagattaccggggacagcacgtatttggggtgccacccctcatccacgtgcagcgcacgggccagccactgccacagagcattcagcaagccatgcgctacttgcgcagccagtgcctggaccaagtaggcatcttccgcaagtctggggtcaagtccaggatccagaacctgcgtcaaatgaatgagacctcgcctgacaatgtctgctacgagggccagtcagcctacgacgtggctgacctgctaaagcagtatttccgggacctgcctgagcccatcttcaccagcaagctcaccaccactttcctccagatctaccagctcctccccaaggatcagtggttggcagcagcacaagccgccaccttgctgctccccgatgagaaccgagaggtgctacagaccctgctctacttcttaagtgacattgcctctgccgaggaaaaccagatgacagcaggcaacctggcagtgtgcctggcgccctccatcttccacctcaatgtctctaagaaggatagcccctctcccaggatcaagagcaaacgcagcctcattggcaggccaggccctagggacctgagtgacaacatggcagccacccagggcctgtcgcacatgatcagtgactgcaagaaacttttccaggtgccccaggacatggtgctgcagctgtgcagctcctacagcgcagctgagctcagccctcccggcccagccctggctgagctgcgtcaggcccaagctgcaggggtaagcctgagcctctacatggaagagaatatccaggacctgctgcgtgatgctgctgagcgcttcaagggctggatgagcgtgccagggccccagcacacggagctggcttgcaggaaggcaccggatgggcaccccctgcggctatggaaggcatccacagaggtggcagcccccccagctgtggtgctgcatcgtgttctccgggagcgggccctctgggatgaggatctgctgcgggcccaggtgctggaagccctgatgccgggtgtggagctgtaccactatgtcaccgacagcatggcaccccatccctgccgcgactttgtggtgcttcggatgtggcgctctgacctgcctcgtgggggttgcctgcttgtctcccagtccctggatccggaacaacctgtgccagagtcgggtgtgcgagccctcatgctcacatcccagtacctcatggagccttgcggcttgggccgctctcggctcacacacatctgccgggctgacctcaggggccgttctcctgactggtacaacaaagtctttggacacctgtgtgccatggaagtggcaaagatccgggactccttccccaccctgcaggcagcgggccctgagacaaagctgtgagccttgggctggtcccagggtggcaccacccaggccccctgggcaccaagggagcgagggggaataagagcagggcagccccctgggtgccgctgtcaggagcagagccaggcccaggtggctccagctgcctgtcctgtcccctttcctaaagctcctctgcacatagaggggagaaaaagagaatttaggcaactccactcccccttcacccccaaccctgtattctactctcccgaaaagagaagagaatcgcatgagtagcaagactgctgccaccagccacctgcttgtgaggccgccacttggcatgaagcctccacagctccccgcctgcaggggcaaagaggtcgacagcaatgtgtgatcccagctctctgccagactgagagggcaagccgtcttgtttgctgcaaggatgcttttgaggttggacaggaggttctggtcctgcctttggggccaacgctggctctgaagtgtctttttcagaggaattggactggagtgaatgggcacaggggtggagcgcagggcagccccagtcaccacgagctgtttcatttgtgtaaatacgatgctgaattttatgaggctgagttaagagtgggcactgacgggcccctaatatgtgacatgacgatttggcatagatagggatgtgagagtggagtaccttcctttctcaagtctcgagatgccagtgaaaccagtattccctgacttgggtttcacactttatcgaccaccccatggggtcctgtgtagcctttggccacgcactgacactgcccaggccaagcaaaagcagagtgtggttaagagacaagggtctatgtcatcatcccttttgcttatggtagtgggctaacataacagcccctttctcaagcagagacctggcccctgggccagccagatggaagggcctatcttagccagctggagcttaagccaaacctgttctgtcccactggccagccatctttgctcacatggaaattcaaatgccattcaaaggccactggtgctttatttttctatctgctgagtaaactgaaatgagatgggtcccaaccaccactgtaattttcaagcctattttatttgtacctgtaaatactgtacagctaatatatatatatatatatatatatgtgtgtgtgtgtgtgtgtgtatatgtgtttatagagatacacacacatatatatgtgtgtatatatatacacatacatatatatacacacacgcatttgcacagacacacacatatatcaattctcatgagtgtattataatctctggtgggggcaagtgtctggaaggcctgaggggcacttcagatgagaatggagaggtagggagccaggtgcagcaggatccctcaaatcaataaagcattaccagagat

SEQ ID NO: 30066 - DNA, 4841 bp, Homo sapiens
agggaccgggctggctctcgccgagccccgggcctcttttagcctcgtccccagagagggaggagccggtgcccggcacagccccgccggccctagaagctccccacgcgccaccatgcctctgctggacgttttctggtcttgcttcaggaaggtgaagtgcttcccattgctgcaggtgaagaagaacgctgaagccgaggccaaaagagcatgtgagtggcttcaagcaacaggattccctcagtatgtgcagctttttgaagaaggttcgtttcccctggatattggctctgtgaagaaaaaccacggttttctggacgaggactctttgggggccctgtgtaggaggctgatgaccttgaataattgtgcctcgatgaaactggaggttcattttcaaagcaagcagaatgaagactcagaagaggaagagcagtgtaccatcagtagccactgggccttccagcaggaaagtaagtgctggtctcctatggggtcctctgatctgttggccccaccgagccctggcctgccagcgacctcaagctgtgagagcgtcctcaccgagcttagtgccacctctctgccagtcatcaccgtgagcctaccacccgagccagcagacttgcccttgccaggccgtgcccccagctcgagtgaccggcccctcctcagccccacccagggccaggagggtccccaggacaaagccaagaagcgccatcgtaaccgtagcttcctcaagcaccttgaatctctgaggcggaaggaaaagagtggcagccagcaagcagagcccaagcatagtccagccacctcagagaaggtctccaaagcctcatctttccgcagttgtcgtggcttcctctcagctggattttacagggccaagaactgggccgccacctcagccggtggcagtggtgccaatactcggaaggcctgggaggcctggcctgtggcctcgttccggcatcctcagtggacacaccggggtgattgcctggtgcacgttcctggggaccacaaaccaggcacattccctcgctccctgtccattgagagcctgtgtcctgaggatggacaccgcctggcagactggcagccaggtaggcggtggggctgtgaggggcgccggggctcctgtggctcaacgggcagccatgccagcacgtatgacaacttgcctgagctgtacccagctgagcctgtaatggttggggctgaggctgaagatgaagatgatgaggagagtgggggcagctatgctcacctagacgacatcctccagcacgtgtgggggctacagcaacgagtagagctgtggtctcgggccatgtacccagacctggggcctggagatgaggaagaggaggaggccacttcatcagtagaaatagccacagttgaggtcaaatgccaagctgaggctctcagccagatggaggttccggcccatggagagtccccagcctgggcccaggctgaagtccagccagcagtcctggctccggctcaggctccagctgaggctgaaccagtggcacaggaagaggctgaggccccggccccagccccggccccggccccagcccaggacagtgagcaggaggcacattcaggcggggaacccacctttgcctctagcctgtctgtggaagaaggacactccatttctgacactgtggcctcctccagcgaacttgacagtagtgggaactccatgaatgaggctgaggctgcggggcccctggctggactccaggcatcaatgccccgtgaacggcgcgattcaggtgttggggcctcacttaccagaccctgcaggaagctccgttggcatagcttccagaactcccatcgtcccagcctcaactcagagtcgctggagatcaaccggcagtttgcaggccagatcaacctcctgcacaagggctcactgctgcggcttaccgcgttcatggagaagtacactgtgccccacaagcagggctgggtctggtcaatgcccaagttcatgaggaggaacaagaccccagattaccggggacagcacgtatttggggtgccacccctcatccacgtgcagcgcacgggccagccactgccacagagcattcagcaagccatgcgctacttgcgcagccagtgcctggaccaagtaggcatcttccgcaagtctggggtcaagtccaggatccagaacctgcgtcaaatgaatgagacctcgcctgacaatgtctgctacgagggccagtcagcctacgacgtggctgacctgctaaagcagtatttccgggacctgcctgagcccatcttcaccagcaagctcaccaccactttcctccagatctaccagctcctccccaaggatcagtggttggcagcagcacaagccgccaccttgctgctccccgatgagaaccgagaggtgctacagaccctgctctacttcttaagtgacattgcctctgccgaggaaaaccagatgacagcaggcaacctggcagtgtgcctggcgccctccatcttccacctcaatgtctctaagaaggatagcccctctcccaggatcaagagcaaacgcagcctcattggcaggccaggccctagggacctgagtgacaacatggcagccacccagggcctgtcgcacatgatcagtgactgcaagaaacttttccaggtgccccaggacatggtgctgcagctgtgcagctcctacagcgcagctgagctcagccctcccggcccagccctggctgagctgcgtcaggcccaagctgcaggggtaagcctgagcctctacatggaagagaatatccaggacctgctgcgtgatgctgctgagcgcttcaagggctggatgagcgtgccagggccccagcacacggagctggcttgcaggaaggcaccggatgggcaccccctgcggctatggaaggcatccacagaggtggcagcccccccagctgtggtgctgcatcgtgttctccgggagcgggccctctgggatgaggatctgctgcgggcccaggtgctggaagccctgatgccgggtgtggagctgtaccactatgtcaccgacagcatggcaccccatccctgccgcgactttgtggtgcttcggatgtggcgctctgacctgcctcgtgggggttgcctgcttgtctcccagtccctggatccggaacaacctgtgccagagtcgggtgtgcgagccctcatgctcacatcccagtacctcatggagccttgcggcttgggccgctctcggctcacacacatctgccgggctgacctcaggggccgttctcctgactggtacaacaaagtctttggacacctgtgtgccatggaagtggcaaagatccgggactccttccccaccctgcaggcagcgggccctgagacaaagctgtgagccttgggctggtcccagggtggcaccacccaggccccctgggcaccaagggagcgagggggaataagagcagggcagccccctgggtgccgctgtcaggagcagagccaggcccaggtggctccagctgcctgtcctgtcccctttcctaaagctcctctgcacatagaggggagaaaaagagaatttaggcaactccactcccccttcacccccaaccctgtattctactctcccgaaaagagaagagaatcgcatgagtagcaagactgctgccaccagccacctgcttgtgaggccgccacttggcatgaagcctccacagctccccgcctgcaggggcaaagaggtcgacagcaatgtgtgatcccagctctctgccagactgagagggcaagccgtcttgtttgctgcaaggatgcttttgaggttggacaggaggttctggtcctgcctttggggccaacgctggctctgaagtgtctttttcagaggaattggactggagtgaatgggcacaggggtggagcgcagggcagccccagtcaccacgagctgtttcatttgtgtaaatacgatgctgaattttatgaggctgagttaagagtgggcactgacgggcccctaatatgtgacatgacgatttggcatagatagggatgtgagagtggagtaccttcctttctcaagtctcgagatgccagtgaaaccagtattccctgacttgggtttcacactttatcgaccaccccatggggtcctgtgtagcctttggccacgcactgacactgcccaggccaagcaaaagcagagtgtggttaagagacaagggtctatgtcatcatcccttttgcttatggtagtgggctaacataacagcccctttctcaagcagagacctggcccctgggccagccagatggaagggcctatcttagccagctggagcttaagccaaacctgttctgtcccactggccagccatctttgctcacatggaaattcaaatgccattcaaaggccactggtgctttatttttctatctgctgagtaaactgaaatgagatgggtcccaaccaccactgtaattttcaagcctattttatttgtacctgtaaatactgtacagctaatatatatatatatatatatatatgtgtgtgtgtgtgtgtgtgtatatgtgtttatagagatacacacacatatatatgtgtgtatatatatacacatacatatatatacacacacgcatttgcacagacacacacatatatcaattctcatgagtgtattataatctctggtgggggcaagtgtctggaaggcctgaggggcacttcagatgagaatggagaggtagggagccaggtgcagcaggatccctcaaatcaataaagcattaccagagatgca

SEQ ID NO: 30067 - DNA, 4864 bp, Homo sapiens
ggccttccaggaggcgggaggcgcccgctgtcgaggcagctgagccccggcaaccgctgctctccgcctctcccctcgcggggccggctcatggagcgcagggaccgggctggctctcgccgagccccgggcctcttttagcctcgtccccagagagggaggagccggtgcccggcacagccccgccggccctagaagctccccacgcgccaccatgcctctgctggacgttttctggtcttgcttcaggaaggtgaagtgcttcccattgctgcaggtgaagaagaacgctgaagccgaggccaaaagagcatgtgagtggcttcaagcaacaggattccctcagtatgtgcagctttttgaaggaggctgatgaccttgaataattgtgcctcgatgaaactggaggttcattttcaaagcaagcagaatgaagactcagaagaggaagagcagtgtaccatcagtagccactgggccttccagcaggaaagtaagtgctggtctcctatggggtcctctgatctgttggccccaccgagccctggcctgccagcgacctcaagctgtgagagcgtcctcaccgagcttagtgccacctctctgccagtcatcaccgtgagcctaccacccgagccagcagacttgcccttgccaggccgtgcccccagctcgagtgaccggcccctcctcagccccacccagggccaggagggtccccaggacaaagccaagaagcgccatcgtaaccgtagcttcctcaagcaccttgaatctctgaggcggaaggaaaagagtggcagccagcaagcagagcccaagcatagtccagccacctcagagaaggtctccaaagcctcatctttccgcagttgtcgtggcttcctctcagctggattttacagggccaagaactgggccgccacctcagccggtggcagtggtgccaatactcggaaggcctgggaggcctggcctgtggcctcgttccggcatcctcagtggacacaccggggtgattgcctggtgcacgttcctggggaccacaaaccaggcacattccctcgctccctgtccattgagagcctgtgtcctgaggatggacaccgcctggcagactggcagccaggtaggcggtggggctgtgaggggcgccggggctcctgtggctcaacgggcagccatgccagcacgtatgacaacttgcctgagctgtacccagctgagcctgtaatggttggggctgaggctgaagatgaagatgatgaggagagtgggggcagctatgctcacctagacgacatcctccagcacgtgtgggggctacagcaacgagtagagctgtggtctcgggccatgtacccagacctggggcctggagatgaggaagaggaggaggccacttcatcagtagaaatagccacagttgaggtcaaatgccaagctgaggctctcagccagatggaggttccggcccatggagagtccccagcctgggcccaggctgaagtccagccagcagtcctggctccggctcaggctccagctgaggctgaaccagtggcacaggaagaggctgaggccccggccccagccccggccccggccccagcccaggacagtgagcaggaggcacattcaggcggggaacccacctttgcctctagcctgtctgtggaagaaggacactccatttctgacactgtggcctcctccagcgaacttgacagtagtgggaactccatgaatgaggctgaggctgcggggcccctggctggactccaggcatcaatgccccgtgaacggcgcgattcaggtgttggggcctcacttaccagaccctgcaggaagctccgttggcatagcttccagaactcccatcgtcccagcctcaactcagagtcgctggagatcaaccggcagtttgcaggccagatcaacctcctgcacaagggctcactgctgcggcttaccgcgttcatggagaagtacactgtgccccacaagcagggctgggtctggtcaatgcccaagttcatgaggaggaacaagaccccagattaccggggacagcacgtatttggggtgccacccctcatccacgtgcagcgcacgggccagccactgccacagagcattcagcaagccatgcgctacttgcgcagccagtgcctggaccaagtaggcatcttccgcaagtctggggtcaagtccaggatccagaacctgcgtcaaatgaatgagacctcgcctgacaatgtctgctacgagggccagtcagcctacgacgtggctgacctgctaaagcagtatttccgggacctgcctgagcccatcttcaccagcaagctcaccaccactttcctccagatctaccagctcctccccaaggatcagtggttggcagcagcacaagccgccaccttgctgctccccgatgagaaccgagaggtgctacagaccctgctctacttcttaagtgacattgcctctgccgaggaaaaccagatgacagcaggcaacctggcagtgtgcctggcgccctccatcttccacctcaatgtctctaagaaggatagcccctctcccaggatcaagagcaaacgcagcctcattggcaggccaggccctagggacctgagtgacaacatggcagccacccagggcctgtcgcacatgatcagtgactgcaagaaacttttccaggtgccccaggacatggtgctgcagctgtgcagctcctacagcgcagctgagctcagccctcccggcccagccctggctgagctgcgtcaggcccaagctgcaggggtaagcctgagcctctacatggaagagaatatccaggacctgctgcgtgatgctgctgagcgcttcaagggctggatgagcgtgccagggccccagcacacggagctggcttgcaggaaggcaccggatgggcaccccctgcggctatggaaggcatccacagaggtggcagcccccccagctgtggtgctgcatcgtgttctccgggagcgggccctctgggatgaggatctgctgcgggcccaggtgctggaagccctgatgccgggtgtggagctgtaccactatgtcaccgacagcatggcaccccatccctgccgcgactttgtggtgcttcggatgtggcgctctgacctgcctcgtgggggttgcctgcttgtctcccagtccctggatccggaacaacctgtgccagagtcgggtgtgcgagccctcatgctcacatcccagtacctcatggagccttgcggcttgggccgctctcggctcacacacatctgccgggctgacctcaggggccgttctcctgactggtacaacaaagtctttggacacctgtgtgccatggaagtggcaaagatccgggactccttccccaccctgcaggcagcgggccctgagacaaagctgtgagccttgggctggtcccagggtggcaccacccaggccccctgggcaccaagggagcgagggggaataagagcagggcagccccctgggtgccgctgtcaggagcagagccaggcccaggtggctccagctgcctgtcctgtcccctttcctaaagctcctctgcacatagaggggagaaaaagagaatttaggcaactccactcccccttcacccccaaccctgtattctactctcccgaaaagagaagagaatcgcatgagtagcaagactgctgccaccagccacctgcttgtgaggccgccacttggcatgaagcctccacagctccccgcctgcaggggcaaagaggtcgacagcaatgtgtgatcccagctctctgccagactgagagggcaagccgtcttgtttgctgcaaggatgcttttgaggttggacaggaggttctggtcctgcctttggggccaacgctggctctgaagtgtctttttcagaggaattggactggagtgaatgggcacaggggtggagcgcagggcagccccagtcaccacgagctgtttcatttgtgtaaatacgatgctgaattttatgaggctgagttaagagtgggcactgacgggcccctaatatgtgacatgacgatttggcatagatagggatgtgagagtggagtaccttcctttctcaagtctcgagatgccagtgaaaccagtattccctgacttgggtttcacactttatcgaccaccccatggggtcctgtgtagcctttggccacgcactgacactgcccaggccaagcaaaagcagagtgtggttaagagacaagggtctatgtcatcatcccttttgcttatggtagtgggctaacataacagcccctttctcaagcagagacctggcccctgggccagccagatggaagggcctatcttagccagctggagcttaagccaaacctgttctgtcccactggccagccatctttgctcacatggaaattcaaatgccattcaaaggccactggtgctttatttttctatctgctgagtaaactgaaatgagatgggtcccaaccaccactgtaattttcaagcctattttatttgtacctgtaaatactgtacagctaatatatatatatatatatatatatgtgtgtgtgtgtgtgtgtgtatatgtgtttatagagatacacacacatatatatgtgtgtatatatatacacatacatatatatacacacacgcatttgcacagacacacacatatatcaattctcatgagtgtattataatctctggtgggggcaagtgtctggaaggcctgaggggcacttcagatgagaatggagaggtagggagccaggtgcagcaggatccctcaaatcaataaagcattaccagagatgcactttaa

SEQ ID NO: 30068 - DNA, 598 bp, Homo sapiens
agagtgtttaaatacattggccctctagggtagcacatcatctcttgaagcttcacttcaacttcactacttctgtagtctcatcttgagtaaaagagaacccagccaactatgaagttccttgtctttgccttcatcttggctctcatggtttccatgattggagctgattcatctgaagagaaatttttgcgtagaattggaagattcggttatgggtatggcccttatcagccagttccagaacaaccactatacccacaaccataccaaccacaataccaacaatataccttttaatatcatcagtaactgcaggacatgattattgaggcttgattggcaaatacgacttctacatccatattctcatctttcataccatatcacactactaccactttttgaagaatcatcaaagagcaatgcaaatgaaaaacactataatttactgtatactctttgtttcaggatacttgccttttcaattgtcacttgatgatataattgcaatttaaactgttaagctgtgttcagtactgtttctgaataatagaaatcacttctctaaaagcaataaatttcaagcacattttta

SEQ ID NO: 30069 - DNA, 534 bp, Homo sapiens
atcatctcttgaagcttcacttcaacttcactacttctgtagtctcatcttgagtaaaagagaacccagccaactatgaagttccttgtctttgccttcatcttggctctcatggtttccatgattggagctgattcatctgaagagtatgggtatggcccttatcagccagttccagaacaaccactatacccacaaccataccaaccacaataccaacaatataccttttaatatcatcagtaactgcaggacatgattattgaggcttgattggcaaatacgacttctacatccatattctcatctttcataccatatcacactactaccactttttgaagaatcatcaaagagcaatgcaaatgaaaaacactataatttactgtatactctttgtttcaggatacttgccttttcaattgtcacttgatgatataattgcaatttaaactgttaagctgtgttcagtactgtttctgaataatagaaatcacttctctaaaagcaataaatttcaagcacatttttaca

SEQ ID NO: 30070 - DNA, 2210 bp, Homo sapiens
agctcctaggaagcttcagggcttaaagctccactctacttggactgtactatcaggcccccaaaatggggggagccgacagggaaggactgatttccatttcaaactgcattctggtactttgtactccagcaccattggccgatcaatatttaatgcttggagattctgactctgcgggagtcatgtcaggggaccttgggagccaatctgcttgagcttctgagtgataattattcatgggctcctgcctcttgctctttctctagcacggtcccactctgcagactcagtgccttattcagtcttctctctcgctctctccgctgctgtagccggaccctttgccttcgccactgctcagcgtctgcacatccctacaatggctaaaacagcaatggcctacaaggaaaaaatgaaggagctgtccatgctgtcactgatctgctcttgcttttacccggaacctcgcaacatcaacatctatacttacgatgatatggaagtgaagcaaatcaacaaacgtgcctctggccaggcttttgagctgatcttgaagccaccatctcctatctcagaagccccacgaactttagcttctccaaagaagaaagacctgtccctggaggagatccagaagaaactggaggctgcagaggaaagaagaaagtctcaggaggcccaggtgctgaaacaattggcagagaagagggaacacgagcgagaagtccttcagaaggctttggaggagaacaacaacttcagcaagatggcggaggaaaagctgatcctgaaaatggaacaaattaaggaaaaccgtgaggctaatctagctgctattattgaacgtctgcaggaaaaggagaggcatgctgcggaggtgcgcaggaacaaggaactccaggttgaactgtctggctgaagcaagggagggtctggcacgccccaccaatagtaaatccccctgcctatattataatggatcatgcgatatcaggatggggaatgtatgacatggtttaaaaagaactcattataaaaaaaaaaaaacaaaaaaaatcaaaaattaaaaaaaatcaatgcggtctctttgcagaatgttttgcttgatgtttaaaaaataccttggatcttattttgtaaatacttacatttttgttaaaaaatacaagtattgcattatgcaagttatttcataatcttacatgtcctgtaacaggcttttgatgttgtgtctttccactcaaatgaatttgctaggtctgttctttttgaagctccccatgtctaactccattccaaaagaaaaatgaggtcagtagacagtctatggtgctagaaacccaccattgcctaatgacctagaaggctttgttgtctctgagcttgactaagaccatacctagatcacaggtattatgactccacatgaaccttcacatttgttcgctcataatctacttactgcctaaaaactacaaaaccaggctaagaaataccaccagtcatagcatttacttctgcttctcctggattatgtgctacaaatgtgctttggctttagaaagggatggatgagaagacagacctgagaccaatctgggtagaagcaaaaagttgaaccttttaaagtgctgaacacaaatccaaattcgaatggttcaagcagccgtgaaatcgctcttcataaagtgggcttaattctctagtttaagttcttttgatggaatgaattaattaatgtgtcaggtggcttatttgtggatgccatgattgatgatgttcattttaagctcttacctatagtacaagtacatgatgctactgaatatttttccacttggaaactgtgagctggttgttgcattaaaacacacatacaaacaaaatcaaaaacactgcggactttcactcaagctggtctttcttccccagtgtaaggcaatcctgcctactaacaacaccaacaacaaaacactccatctgtgaagctgacgcagttaagggggctaggcagggcatttgtgccaactaagaatcaccagatacccaccataagtacctatcgcagttttgaagtcgtttctccccaactcccaactcctgaaggttgctgcctgcatatttactcttcattagtgctattttcctgtatgtcattgtgagcaagctgtgattaataaagaattggagttctgtgaactaataaa

SEQ ID NO: 30071 - DNA, 1516 bp, Homo sapiens
ttctctctcgctctctccgctgctgtagccggaccctttgccttcgccactgctcagcgtctgcacatccctacaatggctaaaacagcaatggcctacaaggaaaaaatgaaggagctgtccatgctgtcactgatctgctcttgcttttacccggaacctcgcaacatcaacatctatacttacgatgatatggaagtgaagcaaatcaacaaacgtgcctctggccaggcttttgagctgatcttgaagccaccatctccaaagaagaaagacctgtccctggaggagatccagaagaaactggaggctgcagaggaaagaagaaagtctcaggaggcccaggtgctgaaacaattggcagagaagagggaacacgagcgagaagtccttcagaaggctttggaggagaacaacaacttcagcaagatggcggaggaaaagctgatcctgaaaatggaacaaattaaggaaaaccgtgaggctaatctagctgctattattgaacgtctgcaggaaaaggagaggcatgctgcggaggtgcgcaggaacaaggaactccaggttgaactgtctggctgaagcaagggagggtctggcacgccccaccaatagtaaatccccctgcctatattataatggatcatgcgatatcaggatggggaatgtatgacatggtttaaaaagaactcattataaaaaaaaaaaaacaaaaaaaatcaaaaattaaaaaaaatcaatgcggtctctttgcagaatgttttgcttgatgtttaaaaaataccttggatcttattttgtaaatacttacatttttgttaaaaaatacaagtattgcattatgcaagttatttcataatcttacatgtcctgtaacaggcttttgatgttgtgtctttccactcaaatgaatttgctaggtctgttctttttgaagctccccatgtctaactccattccaaaagaaaaatgaggtcagtagacagtctatggtgctagaaacccaccattgcctaatgacctagaaggctttgttgtctctgagcttgactaagaccatacctagatcacaggtattatgactccacatgaaccttcacatttgttcgctcataatctacttactgcctaaaaactacaaaaccaggctaagaaataccaccagtcatagcatttacttctgcttctcctggattatgtgctacaaatgtgctttggctttagaaagggatggatgagaagacagacctgagaccaatctgggtagaagcaaaaagttgaaccttttaaagtgctgaacacaaatccaaattcgaatggttcaagcagccgtgaaatcgctcttcataaagtgggcttaattctctagtttaagttcttttgatggaatgaattaattaatgtgtcaggtggcttatttgtggatgccatgattgatgatgttcattttaagctcttacctatagtacaagtacatgatgctactgaatatttttccacttggaaactgtgagct

SEQ ID NO: 30072 - DNA, 799 bp, Homo sapiens
gaccctttgccttcgccactgctcagcgtctgcacatccctacaatggctaaaacagcaatggcctacaaggaaaaaatgaaggagctgtccatgctgtcactgatctgctcttgcttttacccggaacctcgcaacatcaacatctatacttacgatgatatggaagtgaagcaaatcaacaaacgtgcctctggccaggcttttgagctgatcttgaagccaccatctcctatctcagaagccccacgaactttagcttctccaaagaagaaagacctgtccctggaggagatccagaagaaactggaggctgcagaggaaagaagaaagtctcaggaggcccaggtgctgaaacaattggcagagaagagggaacacgagcgagaagtccttcagaaggctttggaggagaacaacaacttcagcaagatggcggaggaaaagctgatcctgaaaatggaacaaattaaggaaaaccgtgaggctaatctagctgctattattgaacgtctgcaggaaaagctggtcaagtttatttcttctgaactaaaagaatctatagagtctcaatttctggagcttcagagggaaggagagaagcaatgagaggcatgctgcggaggtgcgcaggaacaaggaactccaggttgaactgtctggctgaagcaagggagggtctggcacgccccaccaatagtaaatccccctgcctatattataatggatcatgcgatatcaggatggggaatgtatgacatggtttaaaaagaactcattataaaaaaaaaaaaacaaaa

SEQ ID NO: 30073 - DNA, 2255 bp, Homo sapiens
ggcactgcagcaccagccgtctgcagctccggccgccacttgcgcctctccagcctccgcaggcccaaccgccgccagcaccatggccagcaccatttccgcctacaaggagaagatgaaggagctgtcggtgctgtcgctcatctgctcctgcttctacacacagccgcaccccaataccgtctaccagtacggggacatggaggtgaagcagctggacaagcgggcctcaggccagagcttcgaggtcatcctcaagtccccttctgacctgtccccagagagccctatgctctcctccccacccaagaagaaggacacctccctggaggagctgcaaaagcggctggaggcagccgaggagcggaggaagacgcaggaggcgcaggtgctgaagcagctggcggagcggcgcgagcacgagcgcgaggtgctgcacaaggcgctggaggagaataacaacttcagccgccaggcggaggagaagctcaactacaagatggagctcagcaaggagatccgcgaggcacacctggccgcactgcgcgagcggctgcgcgagaaggagctgcacgcggccgaggtgcgcaggaacaaggagcagcgagaagagatgtcgggctaagggcccgggacgggcggcgcccatcctgcgacagaacacgttcgggttttggttttgtttcgttcacctctgtctagatgcaacttttgttcctcctcccccacccccgcccccagcttcatgcttctcttccgcactcagccgccctgccctgtcctcgtggtgagtcgctgaccacggcttcccctgcaggagccgccgggcgtgagacgcggtccctcggtgcagacaccaggccgggcgcggctgggtcccccgggggccctgtgagagaggtggcggtgaccgtggtaaacccagggcggtggcgtgggatcacgggtccttacgctgggctgtctggtcagcacgtgcaggtcagggcaggtcctctgagccggcgcccctggccagcaggcgaggctacagtacctgctgtctttccagggggaaggggctccccatgagggaggggcgacgggggaggggggtgatggtgcctgggagcctgcgtgtgcagccggtgcttgttgaactggcaggcgggtgggtgggggctgcagctttccttaatgtggttgcacaggggtcctctgagaccacctggcgtgaggtggacaccctgggccttcctggaagcctgcagttgggggcctgccctgagtctgctggggagtgggcattctctgccagggacccatgagcaggctgcatggtctagaggttgtgggcagcatggacagtcccccactcagaagtgcaagagttccaaagagcctctggcccaggcccctccccaccagggctttgcagatgtccttgaaagacccaccctagagccctttggagtgctggcccctcctgtgccctctgccctggtggaagcggcagccacaagtcctcctcagggagccccaagggggattttgtgggaccgctgcccacagatccaggtgttggaagggcagcgggtaaggttcccaagccagccccaacacccttcccacttggcacccagagggggctgtgggtggaggcctgactccaggcctctcctgcccacaccctctgggctgagttccttctttcccttggacgcccagtgctggccttggaggacggtcagctggaggatggcggtgggggaggctgtctttgtaccactgcagcatcccccacttctccacggaagccccatcccaaagctgctgcctggccccttgctgtaaagtgtgaagggggcggctgagttctcttaggacccagagccagggccctcaacttccatcctgcgggaggccttggccgggcactgccagtgtcttccagagtcacacccagggaccacgggaggatcctgacccctgcagggctcaggggtcagcagggacccactgccccatctccctctccccaccaagacagccccagaaggagcagccagctgggatgggaacccaaggctgtccacatctggcttttgtgggactcagaaagggaagcagaactgagggctgggatattcctcatggtggcagcgctcatagcgaaagcctactgtaatatgcacccatctcatccacgtagtaaagtgaacttaaaaattcaatcaaatgaacaattaaataaacacctgtgtgtttaagacatg

SEQ ID NO: 30074 - DNA, 970 bp, Homo sapiens
acaccgctgcggcctcggggaccaccctttgcgacgcccgcgccacctgctctggccagaaaagccactgccctttgcgccgcggggtctggatgggggaggggcgactgcgatccccaaaccctccggagaccagagggctccgcccctcccgcccctccacctcccgcggggcggacccaccgccttcgaagcctacaaggagaagatgaaggagctgtcggtgctgtcgctcatctgctcctgcttctacacacagccgcaccccaataccgtctaccagtacggggacatggaggtgaagcagctggacaagcgggcctcaggccagagcttcgaggtcatcctcaagtccccttctgacctgtccccagagagccctatgctctcctccccacccaagaagaaggacacctccctggaggagctgcaaaagcggctggaggcagccgaggagcggaggaagacgcaggaggcgcaggtgctgaagcagctggcggagcggcgcgagcacgagcgcgaggtgctgcacaaggcgctggaggagaataacaacttcagccgccaggcggaggagaagctcaactacaagatggagctcagcaaggagatccgcgaggcacacctggccgcactgcgcgagcggctgcgcgagaaggagctgcacgcggccgaggtgcgcaggaacaaggagcagcgagaagagatgtcgggctaagggcccgggacgggcggcgcccatcctgcgacagaacacgttcgggttttggttttgtttcgttcacctctgtctagatgcaacttttgttcctcctcccccacccccgcccccagcttcatgcttctcttccgcactcagccgccctgccctgtcctcgtggtgagtcgctgaccacggcttcccctgcaggagccgccgggcgtgagacgcggtccctcggtgcagacaccaggccgggcgcggctgggt

SEQ ID NO: 30075 - DNA, 1695 bp, Homo sapiens
agcccgaggggtggaagccggcggcggccgagcggggtcagttctctgtagtgtttgccaatgttggagccgtctgcaaagtgtccccggcaagaagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctctta

SEQ ID NO: 30076 - DNA, 1950 bp, Homo sapiens
agttctctgtagtgtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggttcactactgtgatagacaaagtggcaaagagtgtgtgacctgtctgacattagcccctgtgcagatgactttccatgctattggaagctccattgaagccagccatgatcaggcagccttaagtgccttgaaacaattttctgaacaaggactggatccaatcgatggagcaatgaatatcgaaaaaggttctcttgaaaaacaagccaagcatctgagagagaaagcggacaataaccaggcacccccgggctccatcgctcaggactgcaagaaatcaaactcggccgtctagcagctcccagaacccgcggctgccaccgcatccttataaacctgtcagcacgcatgagggtgtctgtgttcagggaaatgaatgactaataccattatttgagtcttatgtgaagacaacactattctaacacgagagataatatacatggtactgttta

SEQ ID NO: 30077 - DNA, 1603 bp, Homo sapiens
agttctctgtagtgtttgccaatgttggagccgtctgcaaagtgtccccggcaagaaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggcagccttaagtgccttgaaacaattttctgaacaaggactggatccaatcgatggagcaatgaatatcgaaaaaggttctcttgaaaaacaagccaagcatctgagagagaaagcggacaataaccaggcacccccgggctccatcgctcaggactgcaagaaatcaaactcggccgtctagcagctcccagaacccgcggctgccaccgcatccttataaacctgtcagcacgcatgagggtgtctgtgttcagggaaatgaatgactaataccattatttgagtcttatgtgaagacaacactattctaacacgagagataatatacatggtactgtttattcaactggggaaaaataaaactttgagcatttcccttggaactcgagatcagatcataactcatttgcctagaggcagcag

SEQ ID NO: 30078 - DNA, 4061 bp, Homo sapiens
agttctctgtagtgtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctcttatttttgatctatctagtaattcttttgctgcctgtctcttctccattttccttcttcttttttaagcatttttcatattcttcactgtcttctatttggtcttgattaggtgcatctatctcttcgctctgtcttccacaaacaaaaattctgccttcagacatttggtgttagtatttcacactcagttctccctttttttacataaggattgagtttctttttatgatgattttacctttatagcaattttgaattttgcattctattgctagtattgattcaggtacaccattaagatacaacattctagaagtctattaccttaggagttaattaaacatgatatttgaagaataatgaaatgctttatagttgtttgaggcataacaatgtgtatttgttttactggatcatgttttgaactgactagggagggtagcacctgcctcagatagtaccaacaattctgtttcactgggtagtctaaaactagcttatagtttaacttaacttgttgtgtatgtgaatttagggatggaaactttttttcccctatttattctttgtttccttctgggaaaaaaccccacaaaaatcagcactcctttatggatacattggagcttttgaaagaattgtaaactctaggaaggggaaatatctgtgtcttgatttcttagttgccttgaaaatcatgtactgaactgtaaccgctaacttgactggatgaactagtttgcttgtgtgtagagagtgtattgcttcctcagatttcactgttttcatctccttttccatcttagtctttattccttaagaccaaaaactgtaatatcctttagaaatgctctagaagatctgtattgtgtagaatgatcatgtatttataaatattttacaagtttagattataaaatgaaaaagaaggtcatgtgttttggggggtattttgcatgttcggatttttttttcacttcaccgaacccttctgattctttcaaactattgccaggtagttgttagtgtttctaattggactcttaatatgaacttcaagaagctgttaccagttatcggctctgtcatctgaaattttaaccacttaatttaaagttacaattttagaatttgtttttgttgttttaccttaagaaacacaataaatcactgtttaaaaaagatctcaatttatataaagtactggaaaaaagctaagtaatttttagttctatctataatctccgtaggatgaattagaaataaattgtgatgaaaagaaattaactgcttatttatgaatctaatcatttagaaatgtctgagagtaacactgcattcttatagaaacaaagcacaaattgcattcaagctctgaattgattttttgcttggagctgttgttacagtagctgtaattttgctaccagaatgtcttaattttttaaatttgtttttatttctaagctcttggcaatgacaataattataattttaacatatcttcactgtagtcaacatgtagagtctgcttccctcattattgcattgctaaggcctttttaaaaagcttatgcttacataatatactcttttttatggacacgttatatgtttccaaatctgtgtattgtgatttttacatactaatgaatataaacaggtgattttaaaatattactgtgcttctttggttgaatgagctggtattgatgtaaaatactctgtcattgatggaccactacctgcagctaagcagtgagcagaatctccgggaaatgacttagtctggccacatgcatagcccatcttcataatgtcgcagcagaaggttctttgtggttaaaagttttaaagcctatttctttataggtaaccctctcaggtatatttacctggtagaaaaacatgtagattgtttctattacttaaatgttttaattggactgtagtttagaaattacaggaccagcttgttacagattatacactattctgttacttttatttctgaaacttaaaaacaataaattctttttctgtgtttctaggttagaacttttttattttattgcacactgaacagatactgttgcttattgaatattgtgtaaacccttctttggctttccttgcccattgcaatttgatttaagcctactagagccattgtatgtgacagctatattgtattacaaagtaaaaatatatgagtgtattgaaaac

SEQ ID NO: 30079 - DNA, 727 bp, Homo sapiens
agcggggtcagttctctgtagtgtttgccaatgttggagccgtctgcaaagtgtccccggcaagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatg

SEQ ID NO: 30080 - DNA, 550 bp, Homo sapiens
agttctctgtagtgtttgccaatgttggagccgtctgcaaagtgtccccggcaagaagagacgattttgccgtgttcgccaggctagtctcgaactcctgacctcaggtgatccgtccgcctcagactccaaaagtgctgggattacaggcgtgagccaccacacccagctgaggaggtggattttatgaaaccaaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactcc

SEQ ID NO: 30081 - DNA, 2173 bp, Homo sapiens
actcttgcctcataaatctaggattcagggcattgttttcaatggttctcatttttggctccaaggattctttttcatgtgactaatattttcggtagaagaggaggtctggccacgccgcgggtcttggcgagcaggtgatcacggatccctggtgtttgctgggcgagacggtgaagcaacctcctccccgccccctcccccgtctagaaaggtgcaagatccgctaaaccgtgcgttgcacagcggcggccggagcagacgcgggatggtcgcgcgtcccctgcacagcacagaggggcagccggagagcctgggaaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctcttatttttgatctatctagtaattcttttgctgcctgtctcttctccattttccttcttcttttttaagcatttttcatattcttcactgtcttctatttggtcttgattaggtgcatctatctcttcgctctgtcttccacaaacaaaaattctgccttcagacatttggtgttagtatttcacactca

SEQ ID NO: 30082 - DNA, 2646 bp, Homo sapiens
agcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggcagccttaagtgccttgaaacaattttctgaacaaggactggatccaatcgatggagcaatgaatatcgaaaaaggttctcttgaaaaacaagccaagcatctgagagagaaagcggacaataaccaggcacccccgggctccatcgctcaggactgcaagaaatcaaactcggccgtctagcagctcccagaacccgcggctgccaccgcatccttataaacctgtcagcacgcatgagggtgtctgtgttcagggaaatgaatgactaataccattatttgagtcttatgtgaagacaacactattctaacacgagagataatatacatggtactgtttattcaactggggaaaaataaaactttgagcatttcccttggaactcgagatcagatcataactcatttgcctagaggcagcagaaatctgatcctgctactggagcttaaaataacaagtaaagaaaagtgttagaaacaaagctaaaattttaacatgattaataatagagaagttgggtttggttctgttgttatgattgttttgtcgtggtgcttgtgttcagttatattctctctctctctcatttcaaatactgcttgacaattcgaaaatgaaccaatgatgtgctgtggaatgtgatggttgtcttcatatagagtcacatggtttctctttttatgcagatatttataatcttcatcctatatcagtaggaataactataaggtgcactacaaaaagatgtatgcaaacaaacatgttttaaatcaggtcagatatctgatgaaaaatacgaactaatgttaagagcaagtagtttcaacatactccaggaactgagaaacaaaacaaagcaattgtgggttttgagctccatatactcttagcaagtaagggggcgtcttgcccctatatatcatcttcccggattccactccctgttgtgggaatcgcgcccacccccatccgtgtgttgtagccactcacggtttgcatcaagagtgttttttgtaactgcctctggacttgggacagtgagtaggatcaaaaataaataatgtacatgacggggaagggaaaaacctgttggagttgcttccagccagccacgctccgggccagcatgttggaatccagcgtggagcagatgcagtaaaaatgtggttggtttctgtgtgaa

SEQ ID NO: 30083 - DNA, 2173 bp, Homo sapiens
agttctctgtagtgtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagagatgaagagttacctaagtcagtgttataagatgttccatggtaaaagggatttgaagacaaattttggaaatgctgcatactgtatctctcttgaagactcctaaaggtgtcatgaagaaaactgtttacctaagtggttcctaacactgactgaacatcaggctttcctgggcagctttaaaaattctgatgcccagactttatgtggactaattaaatcagaatttctggttgcagagcttgaaccgcactgttttttaaaacttccccaagtaattctatgtccagtcatttaaatactggtccccacaacccaaaacacattaccctctattaacatcaaagattatgagatggtttgaatagtcatagaacttttgaaagaagtaaagaagaagggaagaattacagttaaccacactccttaaggataattgttctggacagctagcttccccacattgctgagggttcacttttttttggaacctaaaactttacttagttcagtaattttggatagaaatatttctaaaagttatggcatatattttttatatccttaaatagaaaatgccacaattcttagcatgaagaatccttgctgttgactcattatcaaccttataaacaataagtattacaagcctcatgagatatgtacatggtttgtccttataccagataatcctagacatctgtttctagagtacccaagtgtgcttttagttactttccaaatcattgttgtcagtcagattgtcatcttatttcttgtttttgtcagtgcacctttgcatattgcttgctcctttctttgatgcttttcaattgctattatcttgaaaaccgatattattgtttgaatttggggcaaagtaagagtagcagggctttaattacgccctaagatgtccccttaactgtggaaaacatcgagttttatctagttggtgaatttttttacttcagaatttatttttttctgtcataaattttgctaaggatctgcattttgagtagaatgaagtggccagatagttgaataatggtttggtgaatatctatatgtatatatgtatgtgtatgtgtgttacacatacatatttaatgacatgaagtactttggttgcttggaattggacagaaataacagtttttttttttttttgggacagagtcttgctctgtcacctaggctggagtgcaatggcgcgatctctgctcactgcaacttccacctcccaggttcaagtgattctcctgccgcagcctcccgagtagctgggattgcaggcgcctgccagcatgcccgccagcacgcctggctaatttttttttttgtatttttagtagagatggggtttcactatgttggccaggctggtcttggaactcctgatctcgtgatctgtgtgccttggcctcccaaagtgctgggattacaggcgtgagccaccgcgcctggccagaaataacagttttaataaatttcatgaaatcactttcttgtatgttaaaggaaacagaaagggttcatttgtgcatggtttagtctttcttttgaatgtggaagtttttcttcttatttgtgtgtctaaaaaaattaaaaagtgaaacattttccaaaatgagaaga

SEQ ID NO: 30084 - DNA, 3065 bp, Homo sapiens
agggcgcggcgggagcgccggggaggcgggcggaggcgggcggaggcggggggcggggagcccgaggggtggaagccggcggcggccgagcggggtcagttctctgtagtgtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagcttctctccaagataaaatggcaaacccaaaagagaaaactgcaatgtgtctggtaaatgagttagcccgtttcaatagagtccaaccccagtataaacttctgaatgaaagagggcctgctcattcaaagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatgtggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggcagccttaagtgccttgaaacaattttctgaacaaggactggatccaatcgatggagcaatgaatatcgaaaaaggttctcttgaaaaacaagccaagcatctgagagagaaagcggacaataaccaggcacccccgggctccatcgctcaggactgcaagaaatcaaactcggccgtctagcagctcccagaacccgcggctgccaccgcatccttataaacctgtcagcacgcatgagggtgtctgtgttcagggaaatgaatgactaataccattatttgagtcttatgtgaagacaacactattctaacacgagagataatatacatggtactgtttattcaactggggaaaaataaaactttgagcatttcccttggaactcgagatcagatcataactcatttgcctagaggcagcagaaatctgatcctgctactggagcttaaaataacaagtaaagaaaagtgttagaaacaaagctaaaattttaacatgattaataatagagaagttgggtttggttctgttgttatgattgttttgtcgtggtgcttgtgttcagttatattctctctctctctcatttcaaatactgcttgacaattcgaaaatgaaccaatgatgtgctgtggaatgtgatggttgtcttcatatagagtcacatggtttctctttttatgcagatatttataatcttcatcctatatcagtaggaataactataaggtgcactacaaaaagatgtatgcaaacaaacatgttttaaatcaggtcagatatctgatgaaaaatacgaactaatgttaagagcaagtagtttcaacatactccaggaactgagaaacaaaacaaagcaattgtgggttttgagctccatatactcttagcaagtaagggggcgtcttgcccctatatatcatcttcccggattccactccctgttgtgggaatcgcgcccacccccatccgtgtgttgtagccactcacggtttgcatcaagagtgttttttgtaactgcctctggacttgggacagtgagtaggatcaaaaataaataatgtacatgacggggaagggaaaaacctgttggagttgcttccagccagccacgctccgggccagcatgttggaatccagcgtggagcagatgcagtaaaaatgtggttggtttctgtgtg

SEQ ID NO: 30085 - DNA, 2485 bp, Homo sapiens
agtctcctcaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggtatccctgctggcctgggcctgggcttcgggagagcagagggtgctcaggagggtaaggccagggtgtgaagggacttacctcccaaaggttctgcaggggaatctggagctacacacaggagggatcagctcctgggtgtgtcagaggccagcctggggagctctggccactgcttcccatgagctgagggagagggagaggggacccgaggctgaggcataagtggcaggatttcgggaagctggggacacggcagtgatgctgcggtctctcctcccctttccctccaggcccagtgccagcaccctcctgaaccactctttcttcaagcaggtatcgtagccccttcgttctggttctggttctagttctggttctaacaactcacaatccctttagctttctctcccctccctttgaatgagagaaactaccccgcttccgaagcccctgaaagacactgctccttcctctcatggagttggctccgacagcccgtctgccaccaggccatggttccttgccccatggtgtcctgggacccagagcaacaggatctgtcacccacctctctcttctcccccagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgc

SEQ ID NO: 30086 - DNA, 2333 bp, Homo sapiens
cggcgcggcggcggctgctagggcctgccgcagccgcggccactcggaaagggcgggacttccccgcagggcggggtggggcggagcgctctatcagtcctcccggtcgccccactgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggcctacacagtaggaactcatgtcatttcttgtaagtaaaccagagcgaatcaggcggtgggtctcggaaaagttcattgttgagggcttaagagatttggaactatttggagagcagcctccgggtgacactcggagaaaaaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggcccagtgccagcaccctcctgaaccactctttcttcaagcagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgctgctgg

SEQ ID NO: 30087 - DNA, 2304 bp, Homo sapiens
cggcgcggcggcggctgctagggcctgccgcagccgcggccactcggaaagggcgggacttccccgcagggcggggtggggcggagcgctctatcagtcctcccggtcgccccactgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggcctacacagtaggaactcatgtcatttcttgtaagtaaaccagagcgaatcaggcggtgggtctcggaaaagttcattgttgagggcttaagagatttggaactatttggagaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggcccagtgccagcaccctcctgaaccactctttcttcaagcagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgctgctgg

SEQ ID NO: 30088 - DNA, 2768 bp, Homo sapiens
cggcgcggcggcggctgctagggcctgccgcagccgcggccactcggaaagggcgggacttccccgcagggcggggtggggcggagcgctctatcagtcctcccggtcgccccactgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggcctacacagtaggaactcatgtcatttcttaccaatgatgcgagctcagagtcaatagcatccttctctaaacaggaggtcatgagtagctttctgccagagggagggtgttacgagctgctcactgtgataggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggtgactcgccctcccacccctaccaccgaaccttctccccccacttccaccactttgtggagcagtgccttcagcgcaacccggatgccaggtatccctgctggcctgggcctgggcttcgggagagcagagggtgctcaggagggtaaggccagggtgtgaagggacttacctcccaaaggttctgcaggggaatctggagctacacacaggagggatcagctcctgggtgtgtcagaggccagcctggggagctctggccactgcttcccatgagctgagggagagggagaggggacccgaggctgaggcataagtggcaggatttcgggaagctggggacacggcagtgatgctgcggtctctcctcccctttccctccaggcccagtgccagcaccctcctgaaccactctttcttcaagcaggtatcgtagccccttcgttctggttctggttctagttctggttctaacaactcacaatccctttagctttctctcccctccctttgaatgagagaaactaccccgcttccgaagcccctgaaagacactgctccttcctctcatggagttggctccgacagcccgtctgccaccaggccatggttccttgccccatggtgtcctgggacccagagcaacaggatctgtcacccacctctctcttctcccccagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgctgctgg

SEQ ID NO: 30089 - DNA, 2110 bp, Homo sapiens
cggcgcggcggcggctgctagggcctgccgcagccgcggccactcggaaagggcgggacttccccgcagggcggggtggggcggagcgctctatcagtcctcccggtcgccccactgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtaggcctacacagtaggaactcatgtcatttcttgtaagtaaaccagagcgaatcaggcggtgggtctcggaaaagttcattgttgagggcttaagagatttggaactatttggaggcaaaggatttgaggacctgatgactgtgaatctagcaaggtacaaaccaacaggagagtacgtgactgtacggaggattaacctagaagcttgttccaatgagatggtaacattcttgcagggcgagctgcatgtctccaaactcttcaaccatcccaatatcgtgccatatcgagccacttttattgcagacaatgagctgtgggttgtcacatcattcatggcatacggttctgcaaaagatctcatctgtacacacttcatggatggcatgaatgagctggcgattgcttacatcctgcagggggtgctgaaggccctcgactacatccaccacatgggatatgtacacaggagtgtcaaagccagccacatcctgatctctgtggatgggaaggtctacctgtctggtttgcgcagcaacctcagcatgataagccatgggcagcggcagcgagtggtccacgattttcccaagtacagtgtcaaggttctgccgtggctcagccccgaggtcctccagcagaatctccagggttatgatgccaagtctgacatctacagtgtgggaatcacagcctgtgaactggccaacggccatgtcccctttaaggatatgcctgccacccagatgctgctagagaaactgaacggcacagtgccctgcctgttggataccagcaccatccccgctgaggagctgaccatgagcccttcgcgctcagtggccaactctggcctgagtgacagcctgaccaccagcaccccccggccctccaacggcccagtgccagcaccctcctgaaccactctttcttcaagcagatcaagcgacgtgcctcagaggctttgcccgaattgcttcgtcctgtcacccccatcaccaattttgagggcagccagtctcaggaccacagtggaatctttggcctggtaacaaacctggaagagctggaggtggacgattgggagttctgagcctctgcaaactgtgcgcattctccagccagggatgcagaggccacccagaggcccttcctgagggccggccacattcccgccctcctgggcagattgggtagaaaggacattcttccaggaaagttgactgctgactgattgggaaagaaaatcctggagagacacttcactgctccaaggcttttgagacacaagggaatctcaacaaccagggatcaggagggtccaaagccgacattcccagtcctgtgagctcaggtgacctcctccgcagaagagagatgctgctctggccctgggagctgaattccaagcccagggtttggctccttaaacccgaggaccgccacctcttcccagtgcttgcgaccagcctcattctatttaactttgctctcagatgcctcagatgctataggtcagtgaaagggcaagtagtaagctgcctgcctcccttccctcagacctctccctcataattccagagaagggcatttctgtctttttaagcacagactaaggctggaacagtccatccttatccctcttctggcttgggccctgacacctaagtctttcccacggtttatgtgtgtgcctcattcctttcccaccaagaatccatcttagcgcctcctgccagctgccctggtgctttctccaagggccatcagtgtcttgcctagcttgagggcttaagtccttatgctgtgttagtttcgttgtcagaacaaattaaaattttcagagacgctgctgg

SEQ ID NO: 30090 - DNA, 2293 bp, Homo sapiens
ccccgccttctcgctgcccagccccggggagggaggcggggccgcgaccccggcgcgggtggggcgaatgcgttcccagcgggtagcctgggactggtgcagagttccaagcccacggccccggtcgcggcctcgccgccctcccgcgccccgcgccgggagcgggcctagagcgctcgcctcgcccctccgcgagcagggctctggcgcccgcccctgtccgcaccgctggcagcctgaagagagtcgctggccgtggtcgccgctaggtaggatatatctgcatcttgaaaggaagataaaacaaaagccttctttggaatagatggatttttgtcactttctgtgtgaactaaagtgattcaatgtctcttttggattgcttctgcacttcaagaacacaagttgaatcactcagacctgaaaaacagtctgaaaccagtatccatcaatacttggttgatgagccaaccctttcctggtcacgtccatccactagagccagtgaagtactatgttccaccaacgtttctcactatgagctccaagtagaaataggaagaggatttgacaacttgacttctgtccatcttgcacggcatactcccacaggaacactggtaactataaaaattacaaatctggaaaactgcaatgaagaacgcctgaaagctttacagaaagccgtgattctatcccactttttccggcatcccaatattacaacttattggacagttttcactgttggcagctggctttgggttatttctccatttatggcctatggttcagcaagtcaactcttgaggacctattttcctgaaggaatgagtgaaactttaataagaaacattctctttggagccgtgagagggttgaactatctgcaccaaaatggctgtattcacaggagtattaaagccagccatatcctcatttctggtgatggcctagtgaccctctctggcctgtcccatctgcatagtttggttaagcatggacagaggcatagggctgtgtatgatttcccacagttcagcacatcagtgcagccgtggctgagtccagaactactgagacaggatttacatgggtataatgtgaagtcagatatttacagtgttgggattacagcatgtgaattagccagtgggcaggtgcctttccaggacatgcatagaactcagatgctgttacagaaactgaaaggtcctccttatagcccattggatatcagtattttccctcaatcagaatccagaatgaaaaattcccagtcaggtgtagactctgggattggagaaagtgtgcttgtctccagtggaactcacacagtaaatagtgaccgattacacacaccatcctcaaaaactttctctcctgccttctttagcttggtacagctctgtttgcaacaagatcctgagaaaaggccatcagcaagcagtttattgtcccatgttttcttcaaacagatgaaagaagaaagccaggattcaatactttcactgttgcctcctgcttataacaagccatcaatatcattgcctccagtgttaccttggactgagccagaatgtgattttcctgatgaaaaagactcatactgggaattctagggctgccaaatcattttatgtcctatatacttgacactttctccttgctgctttttcttctgtatttctaggtacaaataccagaattatacttgaaaatacagttggtgcactggagaatctattatttaaaaccactctgttcaaaggggcaccagtttgtagtccctctgtttcgcacagagtactatgacaaggaaacatcagaattactaatctagctagtgtcatttattctggaatttttttctaagctgtgactaactctttttatctctcaatataatttttgagccagttaatttttttcagtattttgctgtcccttgggaatgggccctcagaggacagtgcttccaagtacatcttctcccagattctctggcctttttaatgagctattgttaaaccaacaggctagtttatcttacatcagacccttttctggtagagggaaaatgtttgtgctttccctttttcttctgttaatacttatggtaacacctaactgagcctcactcacattaaatgattcacttgaaatatatacagaaattgtaatttgcttttttttaaacaagggggctaaagtaacactttcctacttatgtaaattatagatcctaaattcacgcaccccgtgggagctcaataaagatttactgaattga

SEQ ID NO: 30091 - DNA, 2190 bp, Homo sapiens
cggcctcgccgccctcccgcgccccgcgccgggagcgggcctagagcgctcgcctcgcccctccgcgagcagggctctggcgcccgcccctgtccgcaccgctggcagcctgaagagagtcgctggccgtggtcgccgctaggtaggatatatctgcatcttgaaaggaagataaaacaaaagccttctttggaatagatggatttttgtcactttctgtgtgaactaaagtgattcaatgtctcttttggattgcttctgcacttcaagaacacaagttgaatcactcagacctgaaaaacagtctgaaaccagtatccatcaatacttggttgatgagccaaccctttcctggtcacgtccatccactagagccagtgaagtactatgttccaccaacgtttctcactatgagctccaagtagaaataggaagaggatttgacaacttgacttctgtccatcttgcacggcatactcccacaggaacactggtaactataaaaattacaaatctggaaaactgcaatgaagaacgcctgaaagctttacagaaagccgtgattctatcccactttttccggcatcccaatattacaacttattggacagttttcactgttggcagctggctttgggttatttctccatttatggcctatggttcagcaagtcaactcttgaggacctattttcctgaaggaatgagtgaaactttaataagaaacattctctttggagccgtgagagggttgaactatctgcaccaaaatggctgtattcacaggagtattaaagccagccatatcctcatttctggtgatggcctagtgaccctctctggcctgtcccatctgcatagtttggttaagcatggacagaggcatagggctgtgtatgatttcccacagttcagcacatcagtgcagccgtggctgagtccagaactactgagacaggatttacatgggtataatgtgaagtcagatatttacagtgttgggattacagcatgtgaattagccagtgggcaggtgcctttccaggacatgcatagaactcagatgctgttacagaaactgaaaggtcctccttatagcccattggatatcagtattttccctcaatcagaatccagaatgaaaaattcccagtcaggtgtagactctgggattggagaaagtgtgcttgtctccagtggaactcacacagtaaatagtgaccgattacacacaccatcctcaaaaactttctctcctgccttctttagcttggtacagctctgtttgcaacaagatcctgagaaaaggccatcagcaagcagtttattgtcccatgttttcttcaaacagccttattttgagtttctttaacagatgaaagaagaaagccaggattcaatactttcactgttgcctcctgcttataacaagccatcaatatcattgcctccagtgttaccttggactgagccagaatgtgattttcctgatgaaaaagactcatactgggaattctagggctgccaaatcattttatgtcctatatacttgacactttctccttgctgctttttcttctgtatttctaggtacaaataccagaattatacttgaaaatacagttggtgcactggagaatctattatttaaaaccactctgttcaaaggggcaccagtttgtagtccctctgtttcgcacagagtactatgacaaggaaacatcagaattactaatctagctagtgtcatttattctggaatttttttctaagctgtgactaactctttttatctctcaatataatttttgagccagttaatttttttcagtattttgctgtcccttgggaatgggccctcagaggacagtgcttccaagtacatcttctcccagattctctggcctttttaatgagctattgttaaaccaacaggctagtttatcttacatcagacccttttctggtagagggaaaatgtttgtgctttccctttttcttctgttaatacttatggtaacacctaactgagcctcactcacattaaatgattcacttgaaatatatacagaaattgtaatttgcttttttttaaacaagggggctaaagtaacactttcctacttatgtaaattatagatcctaaattcacgcaccccgtgggagctcaataaagatttactgaattga

SEQ ID NO: 30092 - DNA, 1519 bp, Homo sapiens
cttggctattgttcagcaagtcaactcttgaggacctattttcctgaaggaatgagtgaaactttaataagaaacattctctttggagccgtgagagggttgaactatctgcaccaaaatggctgtattcacaggagtattaaagccagccatatcctcatttctggtgatggcctagtgaccctctctggcctgtcccatctgcatagtttggttaagcatggacagaggcatagggctgtgtatgatttcccacagttcagcacatcagtgcagccgtggctgagtccagaactactgagacaggatttacatgggtataatgtgaagtcagatatttacagtgttgggattacagcatgtgaattagccagtgggcaggtgcctttccaggacatgcatagaactcagatgctgttacagaaactgaaaggtcctccttatagcccattggatatcagtattttccctcaatcagaatccagaatgaaaaattcccagtcaggtgtagactctgggattggagaaagtgtgcttgtctccagtggaactcacacagtaaatagtgaccgattacacacaccatcctcaaaaactttctctcctgccttctttagcttggtacagctctgtttgcaacaagatcctgagaaaaggccatcagcaagcagtttattgtcccatgttttcttcaaacagatgaaagaagaaagccaggattcaatactttcactgttgcctcctgcttataacaagccatcaatatcattgcctccagtgttaccttggactgagccagaatgtgattttcctgatgaaaaagactcatactgggaattctagggctgccaaatcattttatgtcctatatacttgacactttctccttgctgctttttcttctgtatttctaggtacaaataccagaattatacttgaaaatacagttggtgcactggagaatctattatttaaaaccactctgttcaaaggggcaccagtttgtagtccctctgtttcgcacagagtactatgacaaggaaacatcagaattactaatctagctagtgtcatttattctggaatttttttctaagctgtgactaactctttttatctctcaatataatttttgagccagttaatttttttcagtattttgctgtcccttgggaatgggccctcagaggacagtgcttccaagtacatcttctcccagattctctggcctttttaatgagctattgttaaaccaacaggctagtttatcttacatcagacccttttctggtagagggaaaatgtttgtgctttccctttttcttctgttaatacttatggtaacacctaactgagcctcactcacattaaatgattcacttgaaatatatacagaaattgtaatttgcttttttttaaacaagggggctaaagtaacactttcctacttatgtaaattatagatcctaaattcacgcaccccgtgggagctcaataaagatttactgaattgagttta

SEQ ID NO: 30093 - DNA, 1974 bp, Homo sapiens
gaatgcgttcccagcgggtagcctgggactggtgcagagttccaagcccacggccccggtcgcggcctcgccgccctcccctgtccgcaccgctggcagcctgaagagagtcgctggccgtggtcgccgctaggtaggatatatctgcatcttgaaaggaagataaaacaaaagccttctttggaatagatggatttttgtcactttctgtgtgaactaaagtgattcaatgtctcttttggattgcttctgcacttcaagaacacaagttgaatcactcagacctgaaaaacagtctgaaaccagtatccatcaatacttggttgatgagccaaccctttcctggtcacgtccatccactagagccagtgaagtactatgttccaccaacgtttctcactatgagctccaagtagaaataggaagaggatttgacaacttgacttctgtccatcttgcacggcatactcccacaggaacactggtaactataaaaattacaaatctggaaaactgcaatgaagaacgcctgaaagctttacagaaagccgtgattctatcccactttttccggcatcccaatattacaacttattggacagttttcactgttggcagctggctttgggttatttctccatttatggcctatggttcagcaagtcaactcttgaggacctattttcctgaaggaatgagtgaaactttaataagaaacattctctttggagccgtgagagggttgaactatctgcaccaaaatggctgtattcacaggagtattaaagccagccatatcctcatttctggtgatggcctagtgaccctctctggcctgtcccatctgcatagtttggttaagcatggacagaggcatagggctgtgtatgatttcccacagttcagcacatcagtgcagccgtggctgagtccagaactactgagacaggatttacatgggtataatgtgaagtcagatatttacagtgttgggattacagcatgtgaattagccagtgggcaggtgcctttccaggacatgcatagaactcagatgctgttacagaaactgaaaggtcctccttatagcccattggatatcagtattttccctcaatcagaatccagaatgaaaaattcccagtcaggtgtagactctgggattggagaaagtgtgcttgtctccagtggaactcacacagtaaatagtgaccgattacacacaccatcctcaaaaactttctctcctgccttctttagcttggtacagctctgtttgcaacaagatcctgagaaaaggccatcagcaagcagtttattgtcccatgttttcttcaaacagatgaaagaagaaagccaggattcaatactttcactgttgcctcctgcttataacaagccatcaatatcattgcctccagtgttaccttggactgagccagaatgtgattttcctgatgaaaaagactcatactgggaattctagggctgccaaatcattttatgtcctatatacttgacactttctccttgctgctttttcttctgtatttctaggtacaaataccagaattatacttgaaaatacagttggtgcactggagaatctattatttaaaaccactctgttcaaaggggcaccagtttgtagtccctctgtttcgcacagagtactatgacaaggaaacatcagaattactaatctagctagtgtcatttattctggaatttttttctaagctgtgactaactctttttatctctcaatataatttttgagccagttaatttttttcagtattttgctgtcccttgggaatgggccctcagaggacagtgcttccaagtacatcttctcccagattctctggcctttttaatgagctattgttaaaccaacaggctagtttatcttacatcagacccttttctggtagagggaaaatgtttgtgctttccctttttcttctgtta

SEQ ID NO: 30094 - DNA, 2072 bp, Homo sapiens
gatccagcttgggtaggcggggaagcagctggagtgcgaccgccgcggcagccaccctgcaaccgccagtcggagagctaagggcaagtcctgaggttgggcccaggagaaagaaggcaaggagacattgtcccaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactattta

SEQ ID NO: 30095 - DNA, 6873 bp, Homo sapiens
gccccctccgagctccccgactcctccccgcgctccacggctcttcccgactccagtcagcgttcctcgggccctcggcgccacgagctgtccgggcacgcagcccctagcggcgcgtcgctgccaagccggcctccgcgcgcctccctccttccttctcccctggctgttcgcgatccagcttgggtaggcggggaagcagctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaacttctgttttgaaa

SEQ ID NO: 30096 - DNA, 1779 bp, Homo sapiens
agctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggagaaagtgaagagaggaaattggaaaattgtgagtggaccttctgatactgctcctccttgcgtggaaaaggggaaagaactgcatgcatattattcagcgtcctatattcaaaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtga

SEQ ID NO: 30097 - DNA, 6612 bp, Homo sapiens
gatccagcttgggtaggcggggaagcagctggagtgcgaccgccgcggcagccaccctgcaaccgccagtcggagagctaagggcaagtcctgaggttgggcccaggagaaagaaggcaaggagacattgtcccaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaata

SEQ ID NO: 30098 - DNA, 2235 bp, Homo sapiens
gatccagcttgggtaggcggggaagcagctggagtgcgaccgccgcggcagccaccctgcaaccgccagtcggagagctaagggcaagtcctgaggttgggcccaggagaaagaaggcaaggagacattgtcccaggtaggatgtgtcccagatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactattta

SEQ ID NO: 30099 - DNA, 2456 bp, Homo sapiens
agcgttcctcgggccctcggcgccacgagctgtccgggcacgcagcccctagcggcgcgtcgctgccaagccggcctccgcgcgcctccctccttccttctcccctggctgttcgcgatccagcttgggtaggcggggaagcagctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaacttctgttttgaaatgttgtatacacgtggatttttttctcattaaataataattctagta

SEQ ID NO: 30100 - DNA, 2261 bp, Homo sapiens
ttctgctatagagatggaacagtatatggaaagctcccaagaaagtgaagagaggaaattggaaaattgtgagtggaccttctgatactgctcctccttgcgtggaaaaggggaaagaactgcatgcatattattcagcgtcctatattcaaaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctggatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaacttctgttttgaaa

SEQ ID NO: 30101 - DNA, 579 bp, Homo sapiens
taggcggggaagcagctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggagtgaagagaggaaattggaaaattgtgagtggaccttctgatactgctcctccttgcgtggaaaaggggaaagaactgcatgcatattattcagcgtcctatattcaaaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatata

SEQ ID NO: 30102 - DNA, 902 bp, Homo sapiens
caagcagagctctccttcctgaacaaaatgagtccacctggggtttattttctttaaagatttgctcaatagagattttattatctttggtttaaaataaaagttaaaatgatatatttactattttaatgagttacatttaatgttttatggcaacaaaaaagaaatatctgattctgatgtgatttttcagatcatagactacatgtctaaagaagcctataagaaattatggcctatgaagtgtggaatctgagactgctggcaagatggccgactaggaacagctctggtgcacagctcccagcaagatccacgcaggaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgc

SEQ ID NO: 30103 - DNA, 4282 bp, Homo sapiens
gaggaggagcctcgggccgagccaccgccttcgccgcggaccttcagctgccgcggtcgctccgagcggcgggccgcagagatgacatttattcattttatgcatcctgggttctactggtcgtcccacctcagttcctgtagcaaagagacttgagtctgagccactaattatcacccgtgaggtttcctccccgagcaggaagcagcaggccagagctgcgctctctcagtgcactctccaaccaagcatcagtcaccactcccggtccagcccctgtggccaagagctggcgtgcaggctgcgggaggcagctggctgtgcaagaccctggcagggccctcgcctcctgagaaaccgagagtcagaaccaaagccaggctgtcctggttggagactgagccagaaagggtggctcacctcacggtgaggctgtcgagtgacctgagagcctcagaccctcacgtcagccggatgtcgcaccagcctgctgttgccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaagaggcttgtgctgtggtgggttcgatttatccctgcccaccccacccccacaacttcccttttgctacttccccaaggctcttgcagagctagggctctgaaggggagggaaggcaacggctctgcccagagccatccctggagcatgtgagcagcggctggtctcttccctccacctggggcagcagcaggaggcctggggaggaggaaaatcaggcagtcggcctggagtctgtgcctggtcctttgcccggtggtgggaggatggagggattgggctgaagctgctccacctcatccttgctgagtgggggagacattttccctgaaagtcagaagtcaccatagagcctgcaaatggatcctcctgtgagagtgacgtcacctcctttccagagccattagtgagcctggcttgggaacaagtgtaatttccttccctcctttaacctggcgatgagcgtcctttaaaccactgtgccttctcaccctttccatcttcagtttgaatgactcccaggaaggcctagagcagaccctttagaaatcagcccaagggggagagcaagagaaaacactctagggagtaaagctccccgggcgtcagagttgagccctgcctgggctgaaggactgtcttcacgaagtcagtcctgaggaaaaatattggggactccaaatgtcctctggcagaggacccagaaaaccacactggctccaacttcctcctcatggggcattacacttcaaaacagtggggagcaacttttccaccaaagctacaaacctaaaatgctgctgccccaaagcacaagagggaagagcaccgccggggccacaggacgtctgtcctccagtcacaggccatccttgctgctccctactgactctagcttacttcccctgtgaagaaacaggtgttctcggctgagcccccaaccctctgcagaaccaggttgatctgccacagaaaaagcatctttgaagacaaagagggtgaggtcttcatgagtctcctgggcccaaagccatcttctgatggaaggaagagagtagggccagtgaaggctgcccagagagaatgtcacagatgaggctgcccctgccccccccccgccagggaggtttcatgagctcatgtctatgcagcacataagggttcttcagtgaaaagcaggagaagagcccactgcaaggatagctcattaggcacatgaccgatgcagggaaggccatgccggggaagctcttcctgcaggtattttccatctgctgtgccaaggctgagcggcagaaacttgtctcataaattggcactgatggagcatcagctgtggcccacagagagccttgctgagaagggggcaggtaaagcagagattttagcattgccttggcataacaagggcccatcgattccctactaatgagaggcagggagagcatgggcaatggagacccaccaatgatccccaaccccggtgggtactggctgcctgccctgggccagggaatggctccttataccaaagatgctggcacatagcagaacccagtgcacgtcctccccttcccacccacctctggctgaaggtgctcaagagggaagcaattataaggtgggtggcaggagggaacaggtgccacctgctggacaatcacacgaaaggcaggcgggctgtgtactgggccctgactgtgcgtccactgctgtcttccctacctcaccaggctactggcagcagcatcccgagagcacatcatctccacagcctggtaaattccatgtgcctctgggtacaaaagtgcctcaacgacatgctctggaaatcccaaatgccacagtctgaggttgatatctaaaatctatgccttcaaaagagtctctgttttttttttttaacctggtagacagtataaaagcagtgcaaataaacacctaaccttctgc

SEQ ID NO: 30104 - DNA, 3915 bp, Homo sapiens
accgccttcgccgcggaccttcagctgccgcggtcgctccgagcggcgggccgcagaggttcaagcgattctcctgcttcagcctccggagtagctgggattacaggcacgtgccaacacacccagccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaagaggcttgtgctgtggtgggttcgatttatccctgcccaccccacccccacaacttcccttttgctacttccccaaggctcttgcagagctagggctctgaaggggagggaaggcaacggctctgcccagagccatccctggagcatgtgagcagcggctggtctcttccctccacctggggcagcagcaggaggcctggggaggaggaaaatcaggcagtcggcctggagtctgtgcctggtcctttgcccggtggtgggaggatggagggattgggctgaagctgctccacctcatccttgctgagtgggggagacattttccctgaaagtcagaagtcaccatagagcctgcaaatggatcctcctgtgagagtgacgtcacctcctttccagagccattagtgagcctggcttgggaacaagtgtaatttccttccctcctttaacctggcgatgagcgtcctttaaaccactgtgccttctcaccctttccatcttcagtttgaatgactcccaggaaggcctagagcagaccctttagaaatcagcccaagggggagagcaagagaaaacactctagggagtaaagctccccgggcgtcagagttgagccctgcctgggctgaaggactgtcttcacgaagtcagtcctgaggaaaaatattggggactccaaatgtcctctggcagaggacccagaaaaccacactggctccaacttcctcctcatggggcattacacttcaaaacagtggggagcaacttttccaccaaagctacaaacctaaaatgctgctgccccaaagcacaagagggaagagcaccgccggggccacaggacgtctgtcctccagtcacaggccatccttgctgctccctactgactctagcttacttcccctgtgaagaaacaggtgttctcggctgagcccccaaccctctgcagaaccaggttgatctgccacagaaaaagcatctttgaagacaaagagggtgaggtcttcatgagtctcctgggcccaaagccatcttctgatggaaggaagagagtagggccagtgaaggctgcccagagagaatgtcacagatgaggctgcccctgccccccccccgccagggaggtttcatgagctcatgtctatgcagcacataagggttcttcagtgaaaagcaggagaagagcccactgcaaggatagctcattaggcacatgaccgatgcagggaaggccatgccggggaagctcttcctgcaggtattttccatctgctgtgccaaggctgagcggcagaaacttgtctcataaattggcactgatggagcatcagctgtggcccacagagagccttgctgagaagggggcaggtaaagcagagattttagcattgccttggcataacaagggcccatcgattccctactaatgagaggcagggagagcatgggcaatggagacccaccaatgatccccaaccccggtgggtactggctgcctgccctgggccagggaatggctccttataccaaagatgctggcacatagcagaacccagtgcacgtcctccccttcccacccacctctggctgaaggtgctcaagagggaagcaattataaggtgggtggcaggagggaacaggtgccacctgctggacaatcacacgaaaggcaggcgggctgtgtactgggccctgactgtgcgtccactgctgtcttccctacctcaccaggctactggcagcagcatcccgagagcacatcatctccacagcctggtaaattccatgtgcctctgggtacaaaagtgcctcaacgacatgctctggaaatcccaaatgccacagtctgaggttgatatctaaaatctatgccttcaaaagagtctctgttttttttttttaacctggtagacagtataaaagcagtgcaaataaacacctaaccttctgcaaa

SEQ ID NO: 30105 - DNA, 1871 bp, Homo sapiens
agctgccgcggtcgctccgagcggcgggccgcagagccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaa

SEQ ID NO: 30106 - DNA, 3934 bp, Homo sapiens
gaggaggagcctcgggccgagccaccgccttcgccgcggaccttcagctgccgcggtcgctccgagcggcgggccgcagaggtgagtgtaccctcccccggtctccgcggggctgcgtgctgcgcccggtccccgagacgcccagccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaagaggcttgtgctgtggtgggttcgatttatccctgcccaccccacccccacaacttcccttttgctacttccccaaggctcttgcagagctagggctctgaaggggagggaaggcaacggctctgcccagagccatccctggagcatgtgagcagcggctggtctcttccctccacctggggcagcagcaggaggcctggggaggaggaaaatcaggcagtcggcctggagtctgtgcctggtcctttgcccggtggtgggaggatggagggattgggctgaagctgctccacctcatccttgctgagtgggggagacattttccctgaaagtcagaagtcaccatagagcctgcaaatggatcctcctgtgagagtgacgtcacctcctttccagagccattagtgagcctggcttgggaacaagtgtaatttccttccctcctttaacctggcgatgagcgtcctttaaaccactgtgccttctcaccctttccatcttcagtttgaatgactcccaggaaggcctagagcagaccctttagaaatcagcccaagggggagagcaagagaaaacactctagggagtaaagctccccgggcgtcagagttgagccctgcctgggctgaaggactgtcttcacgaagtcagtcctgaggaaaaatattggggactccaaatgtcctctggcagaggacccagaaaaccacactggctccaacttcctcctcatggggcattacacttcaaaacagtggggagcaacttttccaccaaagctacaaacctaaaatgctgctgccccaaagcacaagagggaagagcaccgccggggccacaggacgtctgtcctccagtcacaggccatccttgctgctccctactgactctagcttacttcccctgtgaagaaacaggtgttctcggctgagcccccaaccctctgcagaaccaggttgatctgccacagaaaaagcatctttgaagacaaagagggtgaggtcttcatgagtctcctgggcccaaagccatcttctgatggaaggaagagagtagggccagtgaaggctgcccagagagaatgtcacagatgaggctgcccctgccccccccccgccagggaggtttcatgagctcatgtctatgcagcacataagggttcttcagtgaaaagcaggagaagagcccactgcaaggatagctcattaggcacatgaccgatgcagggaaggccatgccggggaagctcttcctgcaggtattttccatctgctgtgccaaggctgagcggcagaaacttgtctcataaattggcactgatggagcatcagctgtggcccacagagagccttgctgagaagggggcaggtaaagcagagattttagcattgccttggcataacaagggcccatcgattccctactaatgagaggcagggagagcatgggcaatggagacccaccaatgatccccaaccccggtgggtactggctgcctgccctgggccagggaatggctccttataccaaagatgctggcacatagcagaacccagtgcacgtcctccccttcccacccacctctggctgaaggtgctcaagagggaagcaattataaggtgggtggcaggagggaacaggtgccacctgctggacaatcacacgaaaggcaggcgggctgtgtactgggccctgactgtgcgtccactgctgtcttccctacctcaccaggctactggcagcagcatcccgagagcacatcatctccacagcctggtaaattccatgtgcctctgggtacaaaagtgcctcaacgacatgctctggaaatcccaaatgccacagtctgaggttgatatctaaaatctatgccttcaaaagagtctctgttttttttttttaacctggtagacagtataaaagcagtgcaaataaacacctaaccttctgcaaa

SEQ ID NO: 30107 - DNA, 4262 bp, Homo sapiens
accgccttcgccgcggaccttcagctgccgcggtcgctccgagcggcgggccgcagagatgacatttattcattttatgcatcctgggttctactggtcgtcccacctcagttcctgtagcaaagagacttgagtctgagccactaattatcacccgtgaggtttcctccccgagcaggaagcagcaggccagagctgcgctctctcagtgcactctccaaccaagcatcagtcaccactcccggtccagcccctgtggccaagagctggcgtgcaggctgcgggaggcagctggctgtgcaagaccctggcagggccctcgcctcctgagaaaccgagagtcagaaccaaagccaggctgtcctggttggagactgagccagaaagggtggctcacctcacggtgaggctgtcgagtgacctgagagcctcagaccctcacgtcagccggatgtcgcaccagcctgctgttgccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaagaggcttgtgctgtggtgggttcgatttatccctgcccaccccacccccacaacttcccttttgctacttccccaaggctcttgcagagctagggctctgaaggggagggaaggcaacggctctgcccagagccatccctggagcatgtgagcagcggctggtctcttccctccacctggggcagcagcaggaggcctggggaggaggaaaatcaggcagtcggcctggagtctgtgcctggtcctttgcccggtggtgggaggatggagggattgggctgaagctgctccacctcatccttgctgagtgggggagacattttccctgaaagtcagaagtcaccatagagcctgcaaatggatcctcctgtgagagtgacgtcacctcctttccagagccattagtgagcctggcttgggaacaagtgtaatttccttccctcctttaacctggcgatgagcgtcctttaaaccactgtgccttctcaccctttccatcttcagtttgaatgactcccaggaaggcctagagcagaccctttagaaatcagcccaagggggagagcaagagaaaacactctagggagtaaagctccccgggcgtcagagttgagccctgcctgggctgaaggactgtcttcacgaagtcagtcctgaggaaaaatattggggactccaaatgtcctctggcagaggacccagaaaaccacactggctccaacttcctcctcatggggcattacacttcaaaacagtggggagcaacttttccaccaaagctacaaacctaaaatgctgctgccccaaagcacaagagggaagagcaccgccggggccacaggacgtctgtcctccagtcacaggccatccttgctgctccctactgactctagcttacttcccctgtgaagaaacaggtgttctcggctgagcccccaaccctctgcagaaccaggttgatctgccacagaaaaagcatctttgaagacaaagagggtgaggtcttcatgagtctcctgggcccaaagccatcttctgatggaaggaagagagtagggccagtgaaggctgcccagagagaatgtcacagatgaggctgcccctgccccccccccgccagggaggtttcatgagctcatgtctatgcagcacataagggttcttcagtgaaaagcaggagaagagcccactgcaaggatagctcattaggcacatgaccgatgcagggaaggccatgccggggaagctcttcctgcaggtattttccatctgctgtgccaaggctgagcggcagaaacttgtctcataaattggcactgatggagcatcagctgtggcccacagagagccttgctgagaagggggcaggtaaagcagagattttagcattgccttggcataacaagggcccatcgattccctactaatgagaggcagggagagcatgggcaatggagacccaccaatgatccccaaccccggtgggtactggctgcctgccctgggccagggaatggctccttataccaaagatgctggcacatagcagaacccagtgcacgtcctccccttcccacccacctctggctgaaggtgctcaagagggaagcaattataaggtgggtggcaggagggaacaggtgccacctgctggacaatcacacgaaaggcaggcgggctgtgtactgggccctgactgtgcgtccactgctgtcttccctacctcaccaggctactggcagcagcatcccgagagcacatcatctccacagcctggtaaattccatgtgcctctgggtacaaaagtgcctcaacgacatgctctggaaatcccaaatgccacagtctgaggttgatatctaaaatctatgccttcaaaagagtctctgttttttttttttaacctggtagacagtataaaagcagtgcaaataaacacctaaccttctgcaaa

SEQ ID NO: 30108 - DNA, 2103 bp, Homo sapiens
agctgccgcggtcgctccgagcggcgggccgcagagccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtgtgtggcaacttccagtgcaggaaacacaggcagtggaacccgaagacctgaatctcagtcccaagacccccacttacctgccccgcatcatcagacaagtttcctaggccctcggagcttctgctgctcacttgtgcctgtgtccaccccatatggtcatcaagaggatttgagctggacacgttaaatgcaggatgcgtgcagccaacagtggcatgctggcttttgagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaa

SEQ ID NO: 30109 - DNA, 3852 bp, Homo sapiens
tcaagcgattctcctgccttgacctcctgaagtgctaagattacaggtgtgagccactgcacgcagccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctggccgagaagacgagccacgtatgaggtgcctgccctgggctctggaccccgggcacacgagggacggtgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaagaggcttgtgctgtggtgggttcgatttatccctgcccaccccacccccacaacttcccttttgctacttccccaaggctcttgcagagctagggctctgaaggggagggaaggcaacggctctgcccagagccatccctggagcatgtgagcagcggctggtctcttccctccacctggggcagcagcaggaggcctggggaggaggaaaatcaggcagtcggcctggagtctgtgcctggtcctttgcccggtggtgggaggatggagggattgggctgaagctgctccacctcatccttgctgagtgggggagacattttccctgaaagtcagaagtcaccatagagcctgcaaatggatcctcctgtgagagtgacgtcacctcctttccagagccattagtgagcctggcttgggaacaagtgtaatttccttccctcctttaacctggcgatgagcgtcctttaaaccactgtgccttctcaccctttccatcttcagtttgaatgactcccaggaaggcctagagcagaccctttagaaatcagcccaagggggagagcaagagaaaacactctagggagtaaagctccccgggcgtcagagttgagccctgcctgggctgaaggactgtcttcacgaagtcagtcctgaggaaaaatattggggactccaaatgtcctctggcagaggacccagaaaaccacactggctccaacttcctcctcatggggcattacacttcaaaacagtggggagcaacttttccaccaaagctacaaacctaaaatgctgctgccccaaagcacaagagggaagagcaccgccggggccacaggacgtctgtcctccagtcacaggccatccttgctgctccctactgactctagcttacttcccctgtgaagaaacaggtgttctcggctgagcccccaaccctctgcagaaccaggttgatctgccacagaaaaagcatctttgaagacaaagagggtgaggtcttcatgagtctcctgggcccaaagccatcttctgatggaaggaagagagtagggccagtgaaggctgcccagagagaatgtcacagatgaggctgcccctgccccccccccgccagggaggtttcatgagctcatgtctatgcagcacataagggttcttcagtgaaaagcaggagaagagcccactgcaaggatagctcattaggcacatgaccgatgcagggaaggccatgccggggaagctcttcctgcaggtattttccatctgctgtgccaaggctgagcggcagaaacttgtctcataaattggcactgatggagcatcagctgtggcccacagagagccttgctgagaagggggcaggtaaagcagagattttagcattgccttggcataacaagggcccatcgattccctactaatgagaggcagggagagcatgggcaatggagacccaccaatgatccccaaccccggtgggtactggctgcctgccctgggccagggaatggctccttataccaaagatgctggcacatagcagaacccagtgcacgtcctccccttcccacccacctctggctgaaggtgctcaagagggaagcaattataaggtgggtggcaggagggaacaggtgccacctgctggacaatcacacgaaaggcaggcgggctgtgtactgggccctgactgtgcgtccactgctgtcttccctacctcaccaggctactggcagcagcatcccgagagcacatcatctccacagcctggtaaattccatgtgcctctgggtacaaaagtgcctcaacgacatgctctggaaatcccaaatgccacagtctgaggttgatatctaaaatctatgccttcaaaagagtctctgttttttttttttaacctggtagacagtataaaagcagtgcaaataaacacctaaccttctgc

SEQ ID NO: 30110 - DNA, 1878 bp, Homo sapiens
gaggaggagcctcgggccgagccaccgccttcgccgcggaccttcagctgccgcggtcgctccgagcggcgggccgcagagatgacatttattcattttatgcatcctgggttctactggtcgtcccacctcagttcctgtagcaaagagacttgagtctgagccactaattatcacccgtgaggtttcctccccgagcaggaagcagcaggccagagctgcgctctctcagtgcactctccaaccaagcatcagtcaccactcccggtccagcccctgtggccaagagctggcgtgcaggctgcgggaggcagctggctgtgcaagaccctggcagggccctcgcctcctgagaaaccgagagtcagaaccaaagccaggctgtcctggttggagactgagccagaaagggtggctcacctcacggtgaggctgtcgagtgacctgagagcctcagaccctcacgtcagccggatgtcgcaccagcctgctgttgccaccaaaatgccagaagagatggacaagccactgatcagcctccacctggtggacagcgatagtagccttgccaaggtccccgatgaggcccccaaagtgggcatcctgggtagcggggactttgcccgctccctggccacacgcctggtgggctctggcttcaaagtggtggtggggagccgcaaccccaaacgcacagccaggctgtttccctcagcggcccaagtgactttccaagaggaggcagtgagctccccggaggtcatctttgtggctgtgttccgggagcactactcttcactgtgcagtctcagtgaccagctggcgggcaagatcctggtggatgtgagcaaccctacagagcaagagcaccttcagcatcgtgagtccaatgctgagtacctggcctccctcttccccacttgcacagtggtcaaggccttcaatgtcatctctgcctggaccctgcaggctggcccaagggatggtaacaggcaggtgcccatctgcggtgaccagccagaagccaagcgtgctgtctcggagatggcgctcgccatgggcttcatgcccgtggacatgggatccctggcgtcagcctgggaggtggaggccatgcccctgcgcctcctcccggcctggaaggtgcccaccctgctggccctggggctcttcgtctgcttctatgcctacaacttcgtccgggacgttctgcagccctatgtgcaggaaagccagaacaagttcttcaagctgcccgtgtccgtggtcaacaccacactgccgtgcgtggcctacgtgctgctgtcactcgtgtacttgcccggcgtgctggcggctgccctgcagctgcggcgcggcaccaagtaccagcgcttccccgactggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtgtgtggcaacttccagtgcaggaaacacaggcagtggaacccgaagacctgaatctcagtcccaagacccccacttacctgccccgcatcatcagacaagtttcctaggccctcggagcttctgctgctcacttgtgcctgtgtccaccccatatggtcatcaagaggatttgagctggacacgttaa

SEQ ID NO: 30111 - DNA, 2826 bp, Homo sapiens
ctggctggaccactggctacagcaccgcaagcagatcgggctgctcagcttcttctgcgccgccctgcacgccctctacagcttctgcttgccgctgcgccgcgcccaccgctacgacctggtcaacctggcagtcaagcaggtcttggccaacaagagccacctctgggtggaggaggaggtctggcggatggagatctacctctccctgggagtgctggccctcggcacgttgtccctgctggccgtgacctcactgccgtccattgcaaactcgctcaactggagggagttcagcttcgttcagtcctcactgggctttgtggccctcgtgctgagcacactgcacacgctcacctacggctggacccgcgccttcgaggagagccgctacaagttctacctgcctcccaccttcacgctcacgctgctggtgccctgcgtcgtcatcctggccaaagccctgtttctcctgccctgcatcagccgcagactcgccaggatccggagaggctgggagagggagagcaccatcaagttcacgctgcccacagaccacgccctgagcccgttaggttttcttttcttggtggtgcaaagtggtataactgtgtgcaaataggaggtttgaggtccaaattcctgggactcaaatgtatgcagtactattcagaatgatatacacacatatgtgtatatgtatttacatatattccacatatataacaggatttgcaattatacatagctagctaaaaagttgggtctctgagatttcaacttgtagatttaaaaacaagtgccgtacgttaagagaagagcagatcatgctattgtgacatttgcagagatatacacacactttttgtacagaagaggcttgtgctgtggtgggttcgatttatccctgcccaccccacccccacaacttcccttttgctacttccccaaggctcttgcagagctagggctctgaaggggagggaaggcaacggctctgcccagagccatccctggagcatgtgagcagcggctggtctcttccctccacctggggcagcagcaggaggcctggggaggaggaaaatcaggcagtcggcctggagtctgtgcctggtcctttgcccggtggtgggaggatggagggattgggctgaagctgctccacctcatccttgctgagtgggggagacattttccctgaaagtcagaagtcaccatagagcctgcaaatggatcctcctgtgagagtgacgtcacctcctttccagagccattagtgagcctggcttgggaacaagtgtaatttccttccctcctttaacctggcgatgagcgtcctttaaaccactgtgccttctcaccctttccatcttcagtttgaatgactcccaggaaggcctagagcagaccctttagaaatcagcccaagggggagagcaagagaaaacactctagggagtaaagctccccgggcgtcagagttgagccctgcctgggctgaaggactgtcttcacgaagtcagtcctgaggaaaaatattggggactccaaatgtcctctggcagaggacccagaaaaccacactggctccaacttcctcctcatggggcattacacttcaaaacagtggggagcaacttttccaccaaagctacaaacctaaaatgctgctgccccaaagcacaagagggaagagcaccgccggggccacaggacgtctgtcctccagtcacaggccatccttgctgctccctactgactctagcttacttcccctgtgaagaaacaggtgttctcggctgagcccccaaccctctgcagaaccaggttgatctgccacagaaaaagcatctttgaagacaaagagggtgaggtcttcatgagtctcctgggcccaaagccatcttctgatggaaggaagagagtagggccagtgaaggctgcccagagagaatgtcacagatgaggctgcccctgccccccccccgccagggaggtttcatgagctcatgtctatgcagcacataagggttcttcagtgaaaagcaggagaagagcccactgcaaggatagctcattaggcacatgaccgatgcagggaaggccatgccggggaagctcttcctgcaggtattttccatctgctgtgccaaggctgagcggcagaaacttgtctcataaattggcactgatggagcatcagctgtggcccacagagagccttgctgagaagggggcaggtaaagcagagattttagcattgccttggcataacaagggcccatcgattccctactaatgagaggcagggagagcatgggcaatggagacccaccaatgatccccaaccccggtgggtactggctgcctgccctgggccagggaatggctccttataccaaagatgctggcacatagcagaacccagtgcacgtcctccccttcccacccacctctggctgaaggtgctcaagagggaagcaattataaggtgggtggcaggagggaacaggtgccacctgctggacaatcacacgaaaggcaggcgggctgtgtactgggccctgactgtgcgtccactgctgtcttccctacctcaccaggctactggcagcagcatcccgagagcacatcatctccacagcctggtaaattccatgtgcctctgggtacaaaagtgcctcaacgacatgctctggaaatcccaaatgccacagtctgaggttgatatctaaaatctatgccttcaaaagagtctctgttttttttttttaacctggtagacagtataaaagcagtgcaaataaacacctaaccttctgc

SEQ ID NO: 30112 - DNA, 2321 bp, Homo sapiens
gagctgcaggcgcggcgaaacttccctctacccgcccggcccgcggcgcgcaccgttggcgctggacgcttcctccttggaagcgcctctccctcagttatggagaaaacttgtatagatgcacttcctcttactatgaattcttcagaaaagcaagagactgtatgtatttttggaactggtgattttggaagatcactgggattgaaaatgctccagtgtggttattctgttgtttttggaagtcgaaacccccagaagaccaccctactgcccagtggtgcagaagtcttgagctattcagaagcagccaagaagtctggcatcataatcatagcaatccacagagagcattatgattttctcacagaattaactgaggttctcaatggaaaaatattggtagacatcagcaacaacctcaaaatcaatcaatatccagaatctaatgcagagtaccttgctcatttggtgccaggagcccacgtggtaaaagcatttaacaccatctcagcctgggctctccagtcaggagcactggatgcaagtcggcaggcaatactcaagaaggagaatccatttagcacctcctcagcctggctcagtgattcatatgtggctttgggaatacttgggttttttctgtttgtactcttgggaatcacttctttgccatctgttagcaatgcagtcaactggagagagttccgatttgtccagtccaaactgggttatttgaccctgatcttgtgtacagcccacaccctggtgtacggtgggaagagattcctcagcccttcaaatctcagatggtatcttcctgcagcctacgtgttagggcttatcattccttgcactgtgctggtgatcaagtttgtcctaatcatgccatgtgtagacaacacccttacaaggatccgccagggctgggaaaggaactcaaaacactagaaaaagcattgaatggaaaatcaatatttaaaacaaagttcaatttagctggatttctgaactatggttttgaatgtttaaagaagaatgatgggtacagttaggaaagtttttttcttacaccgtgactgagggaaacattgcttgtctttgagaaattgactgacatactggaagagaacaccattttatctcaggttagtgaagaatcagtgcaggtccctgactcttattttcccagaggccatggagctgagattgagactagccttgtggtttcacactaaagagtttccttgttatgggcaacatgcatgacctaatgtcttgcaaaatccaatagaagtattgcagcttccttctctggctcaagggctgagttaagtgaaaggaaaaacagcacaatggtgaccactgataaaggctttattaggtatatctgaggaagtgggtcacatgaaatgtaaaaagggaatgaggtttttgttgttttttggaagtaaaggcaaacataaatattaccatgatgaattctagtgaaatgaccccttgactttgcttttcttaatacagatatttactgagaggaactatttttataacacaagaaaaatttacaattgattaaaagtatccatgtcttggatacatacgtatctatagagctggcatgtaattcttcctctataaagaataggtataggaaagactgaataaaaatggagggatatccccttggatttcacttgcattgtgcaataagcaaagaagggttgataaaagttcttgatcaaaaagttcaaagaaaccagaattttagacagcaagctaaataaatattgtaaaattgcactatattaggttaagtattatttaggtattataatatgctttgtaaattttatattccaaatattgctcaatatttttcatctattaaattaatttctagtgtaaataagtagcttctatatctgtcttagtctattataattgtaaggagtaaaattaaatgaatagtctgcaggtataaatttgaacaatgcatagatgatcgaaaattacggaaaatcatagggcagagaggtgtgaagattcatcattatgtgaaatttggatctttctcaaatccttgctgaaatttaggatggttctcactgtttttctgtgctgatagtaccctttccaaggtgaccttcagggggattaaccttcctagctcaagcaatgagctaaaaggagccttatgcatgatcttcccacatatcaaaataactaaaaggcactgagtttggcatttttctgcctgctctgctaagacctttttttttttttactttcattataacatattatacatgacattatac

SEQ ID NO: 30113 - DNA, 9988 bp, Homo sapiens
gctgagctgcaggcgcggcgaaacttccctctacccgcccggcccgcggcgcgcaccgttggcgctggacgcttcctccttggaagcgcctctccctcagttatggagaaaacttgtatagatgcacttcctcttactatgaattcttcagaaaagcaagagactgtatgtatttttggaactggtgattttggaagatcactgggattgaaaatgctccagtgtggttattctgttgtttttggaagtcgaaacccccagaagaccaccctactgcccagtggtgcagaagtcttgagctattcagaagcagccaagaagtctggcatcataatcatagcaatccacagagagcattatgattttctcacagaattaactgaggttctcaatggaaaaatattggtagacatcagcaacaacctcaaaatcaatcaatatccagaatctaatgcagagtaccttgctcatttggtgccaggagcccacgtggtaaaagcatttaacaccatctcagcctgggctctccagtcaggagcactggatgcaagtcggcaggtgtttgtgtgtggaaatgacagcaaagccaagcaaagagtgatggatattgttcgtaatcttggacttactccaatggatcaaggatcactcatggcagccaaagaaattgaaaagtaccccctgcagctatttccaatgtggaggttccccttctatttgtctgctgtgctgtgtgtcttcttgtttttctattgtgttataagagacgtaatctacccttatgtttatgaaaagaaagataatacatttcgtatggctatttccattccaaatcgtatctttccaataacagcacttacactgcttgctttggtttacctccctggtgttattgctgccattctacaactgtaccgaggcacaaaataccgtcgattcccagactggcttgaccactggatgctttgccgaaagcagcttggcttggtagctctgggatttgccttccttcatgtcctctacacacttgtgattcctattcgatattatgtacgatggagattgggaaacttaaccgttacccaggcaatactcaagaaggagaatccatttagcacctcctcagcctggctcagtgattcatatgtggctttgggaatacttgggttttttctgtttgtactcttgggaatcacttctttgccatctgttagcaatgcagtcaactggagagagttccgatttgtccagtccaaactgggttatttgaccctgatcttgtgtacagcccacaccctggtgtacggtgggaagagattcctcagcccttcaaatctcagatggtatcttcctgcagcctacgtgttagggcttatcattccttgcactgtgctggtgatcaagtttgtcctaatcatgccatgtgtagacaacacccttacaaggatccgccagggctgggaaaggaactcaaaacactagaaaaagcattgaatggaaaatcaatatttaaaacaaagttcaatttagctggatttctgaactatggttttgaatgtttaaagaagaatgatgggtacagttaggaaagtttttttcttacaccgtgactgagggaaacattgcttgtctttgagaaattgactgacatactggaagagaacaccattttatctcaggttagtgaagaatcagtgcaggtccctgactcttattttcccagaggccatggagctgagattgagactagccttgtggtttcacactaaagagtttccttgttatgggcaacatgcatgacctaatgtcttgcaaaatccaatagaagtattgcagcttccttctctggctcaagggctgagttaagtgaaaggaaaaacagcacaatggtgaccactgataaaggctttattaggtatatctgaggaagtgggtcacatgaaatgtaaaaagggaatgaggtttttgttgttttttggaagtaaaggcaaacataaatattaccatgatgaattctagtgaaatgaccccttgactttgcttttcttaatacagatatttactgagaggaactatttttataacacaagaaaaatttacaattgattaaaagtatccatgtcttggatacatacgtatctatagagctggcatgtaattcttcctctataaagaataggtataggaaagactgaataaaaatggagggatatccccttggatttcacttgcattgtgcaataagcaaagaagggttgataaaagttcttgatcaaaaagttcaaagaaaccagaattttagacagcaagctaaataaatattgtaaaattgcactatattaggttaagtattatttaggtattataatatgctttgtaaattttatattccaaatattgctcaatatttttcatctattaaattaatttctagtgtaaataagtagcttctatatctgtcttagtctattataattgtaaggagtaaaattaaatgaatagtctgcaggtataaatttgaacaatgcatagatgatcgaaaattacggaaaatcatagggcagagaggtgtgaagattcatcattatgtgaaatttggatctttctcaaatccttgctgaaatttaggatggttctcactgtttttctgtgctgatagtaccctttccaaggtgaccttcagggggattaaccttcctagctcaagcaatgagctaaaaggagccttatgcatgatcttcccacatatcaaaataactaaaaggcactgagtttggcatttttctgcctgctctgctaagacctttttttttttttactttcattataacatattatacatgacattatacaaaaatgattaaaatatattaaaacaacatcaacaatccaggatatttttctataaaactttttaaaaataattgtatctatatattcaattttacatcctttttcaaaggctttgtttttctaaaggctttgttttcctttttattatttttttcttttttatttttttgagacagtcttgctctgtcgctcaggctggagtgcagtggcacgatctcagctcactgcaacctcctcctcccaggttcaagtgattcttgttcatcagcctcccgagtagctgggactacaggcatgtgccactatgcccagctaatttttgtacttttagtagagacagggtttcaccacattggtcaggctggtcttgaaatgctggcgtcaagtgatctgcctgcctccgcctcacaaagcactgggattacaggcatgaatctggccttacgtaatatattttcttaatggctgcataatatcacatcaaataggcatttttcaaacctctttccttattaaacatgtagactatatccattttttactaaaataaataacatttcagataatatctttgcactgataatgttgccaagccatttctaaagtgaccttatcaatttaattaccattggatgagggtgttgctttcatcgcaccattgtagattgtcttttttatttcaatttgcgtttatttataactggttgcaaaggtacacagaacacacgctccttcaacttatctttgataaacccaagcaaggatacaaaaagttggacgacattgagtagagtcatggtatacggtgctgaccctacagtatcagtggaaaagataaggaaaatgtcactactcacctatgttatgcaaaacagttaggtgtgctggggctggatactgctcttttacttgagcattggttgattaaagtttaggtaccatccaggctggtctagagaagtctttggagttaaccatgctctttttgttaaagaagagagtaatgtgtttatcctggctcatagtccgtcaccgaaaatagaaaatgccatccataggtaaaatgctgacctatagaaaaaaatgaactctacttttatagcctagtaaaaatgctctacctgagtagttaaaagcaattcatgaagcctgaagctaaagagcactctgatggttttggcataatagctgcatttccagacctgacctttggccccaaccacaagtgctccaagccccaccagctgaccaaagaaagcccaagttctccttctgtccttcccacaacctccctgctcccaaaactatgaaattaatttgaccatattaacacagctgactcctccagtttacttaaggtagaaagaatgagtttacaacagatgaaaataagtgctttgggcgaactgtattccttttaacagatccaaactattttacatttaaaaaaaaagttaaactaaacttctttactgctgatatgtttcctgtattctagaaaaatttttacactttcacattatttttgtacactttccccatgttaagggatgatggcttttataaatgtgtattcattaaatgttactttaaaaatatttcctagttttgtttaattctggttttaactcatcagcattccaaataaagttactaaaaggttttgaatcacagtagttccagcatctgggactaaaaatacttcccttcagggataagcaaaagagaaggcagtgcatgggtttgaaagtgcattaacagatctgcagcttcttgcaatgtaagcttgagctcagcggggtggcacagtccagtatgctgtgtgtgcttcagtattaccctcagagaggggagagcatcagatggctaaatggggaggactgcactatcccacgctggatttttgtgagaatttggaggtaaaaaaggctttccttctccatgcagacgccacagggataaggctaatggcttgacaagcagacttcaggttggattcagactgcgtgactgggcattaaatgccttgcacaactggactgctgcagctctgatgggtgttatcctgctttcaaaaatagtattaaaacttacaaataaagagaggactgacaacctggaggaagctggaagcaaatggaaagcccctactgaaaaagccatttcaattagaaattcattcaggagctcttcattcatctattgttcagggatcacaaaagagccatgataatgataaatgcatattatgcatttcacctctgagagcataaaagcttctggaactctgttccaaaattaaggtgtaatggcagtcatggtactgcacacagtagttgcaattttcattctccatcatcacaaccatcatcttcactaccacttctccaacacacacacacacacacacacacacacacacacaccccatgagagcccacagatagccttacagggtcctacttcaattttctataatgaattaggtttacattctagaaaaatccttcactcttctaaaggtttgttcagtagaatttgggaaaagagtataagttactcttcaatgtatcagaagcatttggaccaggtgactccatcttcaatagaggctgagtaaaataagcctgagactggccgggcgcagtgactcacacctgtaatcccagcactttgggaggccaagtcaggtggatcacctgaggtcaggagtttgagaccagcctggccaacatggtgaaaccccatctctactaaaaatataaaaaattagccagcatggtggcgcatgcctgtaatcccagctactctggaggctgaggcaggagaagtgcttggacccaggaagcagaggttacaatgagccaagatcgcgccattgcactccagcctgggtgacaagagtgaaactccgtctcaaaataaataaataaataaataagactgagacctactgggctgcattcccaggacagcaggtgttcttagtcacaggatgagataggagtaagcacaaggtacaggtcacaaagaccttgctgataaaacaggatgcaataaagaagccgtccaaaacctaccaaaaccaagatggcaatgaaagtgatctttggctgtctcagctgttcattatatgctaattataatatattagcagcctaaaatacactcccactagcaccatgacagtttacaaattccatggccacatccagaagttaccctatatgttctaaaagcaggaggagccctcagttctgggaatcatctgcccctttcctgaacatctcatgaataatccatcccttgtttagcatataatcaagaaataactataactatactcagccaggcagcccatgccactgctctgcctatgaaatagcccttttattcctttacagtcttaataaacttgctttcattttatggattcacctcaaattctttcttgtgcaagatccaagaactctctcttggggtctgtattggaccccctttctggtaacatatgcattacctctcctcaagctcgaggcaaagtcctaaagtttcggataagacccatatgagggaggtgaaggatgaagggattgagggcaaagggactgagaaaaggggagtgtggaagagcaagacagtgctcttgccattacccagcaaaagccaaaaggatccagtactacttgctttctgctgtaagggaattttggaaggcttttaatgatacttacagcagagtgccatgcgtaaagcctatgctaacaatttcacatgcattatcttatttaatcctcataacagttctctaaggttctcttcttatccttatttatcagaagaggaaactgagctttgaaatctcagtactttgactaagttcacacaactaatgagaggcagagctgggatctaggcagtctgactccaggcccatctccttttaacacaacgatataataggggacacccatgctgtcctcttaaatgtccctttgaatccacaaaatagactaagtgaacgaaaccactgcaactcttcttaaaaacatttttaaagacaagaagcttattcgcattttaaatattcctgattgcccagtcctcaatactccaggtttatctatgctgatttcaattcgtcctctaaggttgtagaaacacaggatctgtggttcccgcattaagttcaattccattgcaattgccattttaatcttcccactctagtctggccacaaggtttcctaaactctaaagggagctttgttctggtggagggaggtaaaatccccagacctgaggactcgaaggggcagtcaaggagaggatagctcttctccagagcttaaaggcaaatattttctttttccctggtttctcaccttattgctttgtgtactgagtgaacttatttgtttttgagatccagtaacccatgcaagaaatttcataacacttctcatttagtactttaatactagttgaagaatctagggttacacacacacacacacacacacaccaggcttagttccattacctatagctgtaaaaatgagatttttttctcagttttgtgaaaatgaaaggctgctggactggaactcacagtattgtatatcaaaaagtatcagattgtgataaaatagaaacccagaattaaacttggccttatgatttttagaaagtcaacagattttgaaggagcccacccagtgtattcatttcatttttactaatcctttctttcatgctaagatagagatgaaaaagaatgacagacttcctgttctcatttcattacagcaaaataaataagttttagtgttccatagctctgtaggatgactatagttaaaaataacatataatttcaaatagccaggaggacattgactgttcccaacacaaagaaatgataaatgtttgcaatgatggatatgctaattacactgatctgatcactatacattgtacatacataaacatgactatgtacctcatggatatgtacaactgttatttgtcagttttagaaaataaaaaagcagaagagatctgctaccaaatgcaggaattttctatagagtctgttatagctagccttctacaggcttaactcttctcatgatggagtattgaccatcaccaacaggaaatcttttgttttaggcactccaggaaattatcagggagttctctctgtagataaccaaagtttccctagttgtacttctacccatttttcttagtgtgatcatttaaagcagtgcctcaccaactatcagagatgggggccagtaatttttgtttcatttttttccagttcattacaaatcaatgcatatgtctgtaaaacacaaaatcacacccttaaatgtgatggcaacatcaaattgccataaaagtttctaaacttttcaccccaatttctgaatttatcacagactggtaaaaaacagctcacaagccagcaccacgggcagaccacactttgcacagtgctcaaacgtaggcctaacaacctggcttggcttggcacttctaaaaaccgatcctgaggcaaggcttcttgtaaaagagtttatactggaagttaaaaatcatcaaattattagatactgggaatggagtagtaaagtagacagagcagggaaggaataaagtatgaattttcaagctggttacccatctgggcaactggagctcagttttgctgggaaagtctggaagacagtgtcagatataactaagagttattcccatcaaggggaaaggaaactgtgcttttcatccaccaaatccttgcttaacattggaatacagatgcttccaagacattaactttgtggcacttctggcttttcctacacacttattgtgtatgccaccatgtctagggggaaaaaggcccacaggcaaagaggtaccagcattcataccaccagctttcagcttgtagaggtggccgccaagaggaactcgtagttggcagtgccaactacaactactacaccaaccagctggaaactatacaaagagtatgaacaaagttcacaggagaaacaaggctctgcaacatatgaaaatatattctacttcattcataatgagacgcatgaaaattgtaactgtatcaataccatttctcacctagtagatgggcaaaaatccaaatgtttgagcacacattctgtgggtgaggctgtggaaacgtaggttcacatacattgctcttggatatgcagattaggaccgctcctgtggagagcagttagggaatatctttcaaaattaaaaaatgcagagttaagttttgatccaggagtctcactcctgagaatttatgctatagatatgcctacaagcatttgagatgaaaaagaagcattgctatttgtttttcttgtttttcatgaataacattgtaaaagtagaatatgggcagtgattcaagcattcatctttgggactggttaaggaaactatgatgctttcacagaatgaaattctatgcagctgtttaaaacaaaccaagacaccttctttcacatatatggaaagatgtccaaaatatactgttcagtttttaaaaaggtacaaaataacatatatagtatgattccttttgcatatgtgtatttgcttttaattgcctaaagaaactctcagaaggattcaaaagatccataccaaacaagatgggagaacagaggagtagtgacaggagtagaagcactgtagaccttttcatatcattttggtttttaaattacatgagtaggttacctaattattaaaataaatttaatttaaaaggtaatgggggataggaagaaatttgttaaaagatacaaaattacagctagataggaagattaagttgtagtgttctatagctctgtaggatgactacagttaacaataatatatattctaaatagctagaaggaggatattgaatgttctcaacagaaagaaatgataaatgcttaagatgatggatatactaattaccctaatctgatcactgtatattttgtgtattgcaatgtcactatgtaccccataaatatgtataattatcgtgtgtcaattaaaaatttttaattaaaaaattataaacaaaaaa

SEQ ID NO: 30114 - DNA, 5362 bp, Homo sapiens
gtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttttgggttaaaagatggttgtagcatttaaaatggaaaattttctccttggtttgctagtatcttgggtgtattctctgtaagtgtagctcaaataggtcatcatgaaaggttaaaaaagcgaggtggccatgttatgctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttgggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctgattgcactg

SEQ ID NO: 30115 - DNA, 894 bp, Homo sapiens
tggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaactttt

SEQ ID NO: 30116 - DNA, 1977 bp, Homo sapiens
aggcctctcctcagcccacggcgtccatctggctcccgagccgagggccgggcagtcgggcttcgcggctgcccgcggtcccgaggcctcgccctagccccagtcggctcgcgaggcgcgcacagctgagtggacccctgcggcgtggcccgatggtctcgcccgacccggcgcgcgcgggaggccgaggggcggggcccggcgcccacataaaggcggttgggggcggggcgcgcagagctcgtgagcgccggcgcggggacgcgggtttctgcctcaggccctgccctgctctactctgcgctctctgcccgcgccgccgccgcctcagcctcggccctgcgctgcgcgcccggcccgtgctgccatggcctgccgcccgcgaagcccgccgaggcatcagagccgctgcgacggtgacgccagcccgccgtcccccgcgcgatggagcctgggacggaagcgcagagccgacggcaggcgctggaggcccgaagacgccgaggaggcagagcaccgcggcgccgagcgcagacccgagagctttaccactcctgaaggccctaaaccccgttccagatgctctgactgggcaagtgcagttgaagaagatgaaatgaggaccagagttaacaaagaaatggcaagatataaaaggaaactcctcatcaatgactttggaagagagagaaaatcatcatcaggaagttctgattcaaaggagtctatgtctactgtgccggctgactttgagacagatgaaagtgtcctaatgaggagacagaagcagatcaactatgggaagaacacaattgcctacgatcgttatattaaagaagtcccaagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatacaccctgtagaccttgaatctgcagaaagcagctccgagccccagaccagctctcaggatgactttgatgtgtactctggcacacccaccaaggtgagacacatggacagtcaagtggaggatgagtttgatttggaagcttgtttaactgaacccttgagagacttctcagccatgagctaactgccccctggcggccaggaagagaaacagctcctccccgactaggtggaaggctggccaggcaccaagcatgtgtgtgcacttgtacctggtggtttctctgttagcagtccattagctcatgctgaattatttttgccttactttcttaagaaacattaattttatgtatagtgagtatattttgcatgttttaaattgtaaatggagctaagtccaagaaagtacttgaagctctcttccagcgagcttaattgcgtaatccctgttgtcctccagggtaagctgacacgtctacataactggttttccacaggcatcttcagttattgcttgtcaggtggactgttttggatttaaccatgtaatccatgggaccaattgagagtcagctacttttataggcatcaaagtattctcagacacctttaatatctttatggaaacttaatttttggccttttatcaatatgtcataacagcattctgaagtcagacattgttaaattgagctattaaactaatgagttttatgtaagttatatggtcttaatttggtacttgtaaatagcactagttagactctttagaatactccaagagttagggcagcagagtggagcgatttagaaagaacattttaaaacaatcagttaatttaccatgtaaaattgctgtaaatgataatgtgtacagattttctgttcaaatattcaattgtaaacttcttgttaagactgttacgtttctattgcttttgtatgggatattgcaaaaataaaaaggaaagaaccctc

SEQ ID NO: 30117 - DNA, 5515 bp, Homo sapiens
gccctgccctcacctggctatcccacacaggtgagaataaccagaactcacctccggtaccagtgttcacttggaaacatggctctcagcctctggcccctgctgctgctgctgctgctgctgctgctgctgtcctttgcagtgactctggcccctactgggcctcattccctggaccctggtctctccttcctgaagtcattgctctccactctggaccaggctccccagggctccctgagccgctcacggttctttacattcctggccaacatttcttcttcctttgagcctgggagaatgggggaaggaccagtaggagagcccccacctctccagccgcctgctctgcggctccatgattttctagtgacactgagaggtagccccgactgggagccaatgctagggctgctaggggatatgctggcactgctgggacaggagcagactccccgagatttcctggtgcaccaggcaggggtgctgggtggacttgtggaggtgctgctgggagccttagttcctgggggcccccctaccccaactcggcccccatgcacccgtgatgggccgtctgactgtgtcctggctgctgactggttgccttctctgctgctgttgttagagggcacacgctggcaagctctggtgcaggtgcagcccagtgtggaccccaccaatgccacaggcctcgatgggagggaggcagctcctcactttttgcagggtctgttgggtttgcttaccccaacaggggagctaggctccaaggaggctctttggggcggtctgctacgcacagtgggggcccccctctatgctgcctttcaggaggggctgctccgtgtcactcactccctgcaggatgaggtcttctccattttggggcagccagagcctgataccaatgggcagtgccagggaggtaaccttcaacagctgctcttatggggcgtccggcacaacctttcctgggatgtccaggcgctgggctttctgtctggatcaccacccccaccccctgccctccttcactgcctgagcacgggcgtgcctctgcccagagcttctcagccgtcagcccacatcagcccacgccaacggcgagccatcactgtggaggccctctgtgagaaccacttaggcccagcaccaccctacagcatttccaacttctccatccacttgctctgccagcacaccaagcctgccactccacagccccatcccagcaccactgccatctgccagacagctgtgtggtatgcagtgtcctgggcaccaggtgcccaaggctggctacaggcctgccacgaccagtttcctgatgagtttttggatgcgatctgcagtaacctctccttttcagccctgtctggctccaaccgccgcctggtgaagcggctctgtgctggcctgctcccaccccctaccagctgccctgaaggcctgccccctgttcccctcaccccagacatcttttggggctgcttcttggagaatgagactctgtgggctgagcgactgtgtggggaggcaagtctacaggctgtgccccccagcaaccaggcttgggtccagcatgtgtgccagggccccaccccagatgtcactgcctccccaccatgccacattggaccctgtggggaacgctgcccggatgggggcagcttcctggtgatggtctgtgccaatgacaccatgtatgaggtcctggtgcccttctggccttggctagcaggccaatgcaggataagtcgtgggggcaatgacacttgcttcctagaagggctgctgggcccccttctgccctctctgccaccactgggaccatccccactctgtctgacccctggccccttcctccttggcatgctatcccagttgccacgctgtcagtcctctgtcccagctcttgctcaccccacacgcctacactatctcctccgcctgctgaccttcctcttgggtccaggggctgggggcgctgaggcccaggggatgctgggtcgggccctactgctctccagtctcccagacaactgctccttctgggatgcctttcgcccagagggccggcgcagtgtgctacggacgattggggaatacctggaacaagatgaggagcagccaaccccatcaggctttgaacccactgtcaaccccagctctggtataagcaagatggagctgctggcctgctttagtcctgtgctgtgggatctgctccagagggaaaagagtgtttgggccctgcagattctagtgcaggcgtacctgcatatgcccccagaaaacctccagcagctggtgctttcagcagagagggaggctgcacagggcttcctgacactcatgctgcaggggaagctgcaggggaagctgcaggtaccaccatccgaggagcaggccctgggtcgcctgacagccctgctgctccagcggtacccacgcctcacctcccagctcttcattgacctgtcaccactcatccctttcttggctgtctctgacctgatgcgcttcccaccatccctgttagccaacgacagtgtcctggctgccatccgggattacagcccaggaatgaggcctgaacagaaggaggctctggcaaagcgactgctggcccctgaactgtttggggaagtgcctgcctggccccaggagctgctgtgggcagtgctgcccctgctcccccacctccctctggagaactttttgcagctcagccctcaccagatccaggccctggaggatagctggccagcagcaggtctggggccagggcatgcccgccatgtgctgcgcagcctggtaaaccagagtgtccaggatggtgaggagcaggtacgcaggcttgggcccctcgcctgtttcctgagccctgaggagctgcagagcctagtgcccctgagtgatccaacggggccagtagaacgggggctgctggaatgtgcagccaatgggaccctcagcccagaaggacgggtggcatatgaacttctgggtgtgttgcgctcatctggaggagcggtgctgagcccccgggagctgcgggtctgggcccctctcttctctcagctgggcctccgcttccttcaggagctgtcagagccccagcttagagccatgcttcctgtcctgcagggaactagtgttacacctgctcaggctgtcctgctgcttggacggctccttcctaggcacgatctatccctggaggaactctgctccttgcaccttctgctaccaggcctcagcccccagacactccaggccatccctaggcgagtcctggtcggggcttgttcctgcctggcccctgaactgtcacgcctctcagcctgccagaccgcagcactgctgcagacctttcgggttaaagatggtgttaaaaatatgggtacaacaggtgctggtccagctgtgtgtatccctggtcagcctattcccaccacctggccagactgcctgcttcccctgctcccattaaagctgctacaactggattccttggctcttctggcaaatcgaagacgctactgggagctgccctggtctgagcagcaggcacagtttctctggaagaagatgcaagtacccaccaaccttaccctcaggaatctgcaggctctgggcaccctggcaggaggcatgtcctgtgagtttctgcagcagatcaactccatggtagacttccttgaagtggtgcacatgatctatcagctgcccactagagttcgagggagcctgagggcctgtatctgggcagagctacagcggaggatggcaatgccagaaccagaatggacaactgtagggccagaactgaacgggctggatagcaagctactcctggacttaccgatccagttgatggacagactatccaatgaatccattatgttggtggtggagctggtgcaaagagctccagagcagctgctggcactgacccccctccaccaggcagccctggcagagagggcactacaaaacctggctccaaaggagactccagtctcaggggaagtgctggagaccttaggccctttggttggattcctggggacagagagcacacgacagatccccctacagatcctgctgtcccatctcagtcagctgcaaggcttctgcctaggagagacatttgccacagagctgggatggctgctattgcaggagtctgttcttgggaaaccagagttgtggagccaggatgaagtagagcaagctggacgcctagtattcactctgtctactgaggcaatttccttgatccccagggaggccttgggtccagagaccctggagcggcttctagaaaagcagcagagctgggagcagagcagagttggacagctgtgtagggagccacagcttgctgccaagaaagcagccctggtagcaggggtggtgcgaccagctgctgaggatcttccagaacctgtgccaaattgtgcagatgtacgagggacattcccagcagcctggtctgcaacccagattgcagagatggagctctcagactttgaggactgcctgacattatttgcaggagacccaggacttgggcctgaggaactgcgggcagccatgggcaaagcaaaacagttgtggggtcccccccggggatttcgtcctgagcagatcctgcagcttggtaggctcttaataggtctaggagatcgggaactacaggagctgatcctagtggactggggagtgctgagcaccctggggcagatagatggctggagcaccactcagctccgcattgtggtctccagtttcctacggcagagtggtcggcatgtgagccacctggacttcgttcatctgacagcgctgggttatactctctgtggactgcggccagaggagctccagcacatcagcagttgggagttcagccaagcagctctcttcctcggcaccctgcatctccagtgctctgaggaacaactggaggttctggcccacctacttgtactgcctggtgggtttggcccaatcagtaactgggggcctgagatcttcactgaaattggcaccatagcagctgggatcccagacctggctctttcagcactgctgcggggacagatccagggcgttactcctcttgccatttctgtcatccctcctcctaaatttgctgtggtgtttagtcccatccaactatctagtctcaccagtgctcaggctgtggctgtcactcctgagcaaatggcctttctgagtcctgagcagcgacgagcagttgcatgggcccaacatgagggaaaggagagcccagaacagcaaggtcgaagtacagcctggggcctccaggactggtcacgaccttcctggtccctggtattgactatcagcttccttggccacctgctatgagcctgtctctacagtagaaggagattgtggggagagaaatcttaagtcataatgaataaagtgcaaacagaagtgcatcctgattattttcagaagctgatgaggaata

SEQ ID NO: 30118 - DNA, 1711 bp, Homo sapiens
agagactcactcttccgatattttgagttgctagaaaagcttcagtgtaacctagaggagcataagaagttacaagagtttgcagaaccccagattacacccctggtctccagttctccatctccatgtctgcctgttcctttctgcatcactggctcctaactcaagcaatctccttgggtttctctgaggggcccctgggatcccctatcattagtccctctcacagaagcatacccttctccagagctaaaggatcagatattcagcggctcaggtgagaataaccagaactcacctccggtaccagtgttcacttggaaacatggctctcagcctctggcccctgctgctgctgctgctgctgctgctgctgctgtcctttgcagtgactctggcccctactgggcctcattccctggaccctggtctctccttcctgaagtcattgctctccactctggaccaggctccccagggctccctgagccgctcacggttctttacattcctggccaacatttcttcttcctttgagcctgggagaatgggggaaggaccagtaggagagcccccacctctccagccgcctgctctgcggctccatgattttctagtgacactgagaggtagccccgactgggagccaatgctagggctgctaggggatatgctggcactgctgggacaggagcagactccccgagatttcctggtgcaccaggcaggggtgctgggtggacttgtggaggtgctgctgggagccttagttcctgggggcccccctaccccaactcagcccccatgcacccgtgatgggccgtctgactgtgtcctggctgctgactggttgccttctctgctgctgttgttagagggcacacgctggcaagctctggtgcaggtgcagcccagtgtggaccccaccaatgccacaggcctcgatgggagggaggcagctcctcactttttgcagggtctgttgggtttgcttaccccaacaggggagctaggctccaaggaggctctttggggcggtctgctacgcacagtgggggcccccctctatgctgcctttcaggaggggctgctccgtgtcactcactccctgcaggatgaggtcttctccattttggggcagccagagcctgataccaatgggcagtgccagggaggtaaccttcaacagctgctcttatggggcgtccggcacaacctttcctgggatgtccaggcgctgggctttctgtctggatcaccacccccaccccctgccctccttcactgcctgagcacgggcgtgcctctgcccagagcttctcagccgtcagcccacatcagcccacgccaacggcgagccatcactgtggaggccctctagggccggcgcagtgtgctacggacgattggggaatacctggaacaagatgaggagcagccaaccccatcaggctttgaacccactgtcaaccccagctctggtataagcaagatggagctgctggcctgctttagtcctgtgctgtgggatctgctccagagggaaaagagtgtttgggccctgcagattctagtgcaggcgtacctgcatatgcccccagaaaacctccagcagctggtgctttcagcagagagggaggctgcacagggcttcctgacactcatgctgcaggggaagctgcaggtaccaccatccgaggagcaggccctg

SEQ ID NO: 30119 - DNA, 5680 bp, Homo sapiens
gccctgccctcacctggctatcccacacaggtgagaataaccagaactcacctccggtaccagtgttcacttggaaacatggctctcagcctctggcccctgctgctgctgctgctgctgctgctgctgctgtcctttgcagtgactctggcccctactgggcctcattccctggaccctggtctctccttcctgaagtcattgctctccactctggaccaggctccccagggctccctgagccgctcacggttctttacattcctggccaacatttcttcttcctttgagcctgggagaatgggggaaggaccagtaggagagcccccacctctccagccgcctgctctgcggctccatgattttctagtgacactgagaggtagccccgactgggagccaatgctagggctgctaggggatatgctggcactgctgggacaggagcagactccccgagatttcctggtgcaccaggcaggggtgctgggtggacttgtggaggtgctgctgggagccttagttcctgggggcccccctaccccaactcggcccccatgcacccgtgatgggccgtctgactgtgtcctggctgctgactggttgccttctctgctgctgttgttagagggcacacgctggcaagctctggtgcaggtgcagcccagtgtggaccccaccaatgccacaggcctcgatgggagggaggcagctcctcactttttgcagggtctgttgggtttgcttaccccaacaggggagctaggctccaaggaggctctttggggcggtctgctacgcacagtgggggcccccctctatgctgcctttcaggaggggctgctccgtgtcactcactccctgcaggatgaggtcttctccattttggggcagccagagcctgataccaatgggcagtgccagggaggtaaccttcaacagctgctcttatggggcgtccggcacaacctttcctgggatgtccaggcgctgggctttctgtctggatcaccacccccaccccctgccctccttcactgcctgagcacgggcgtgcctctgcccagagcttctcagccgtcagcccacatcagcccacgccaacggcgagccatcactgtggaggccctctgtgagaaccacttaggcccagcaccaccctacagcatttccaacttctccatccacttgctctgccagcacaccaagcctgccactccacagccccatcccagcaccactgccatctgccagacagctgtgtggtatgcagtgtcctgggcaccaggtgcccaaggctggctacaggcctgccacgaccagtttcctgatgagtttttggatgcgatctgcagtaacctctccttttcagccctgtctggctccaaccgccgcctggtgaagcggctctgtgctggcctgctcccaccccctaccagctgccctgaaggcctgccccctgttcccctcaccccagacatcttttggggctgcttcttggagaatgagactctgtgggctgagcgactgtgtggggaggcaagtctacaggctgtgccccccagcaaccaggcttgggtccagcatgtgtgccagggccccaccccagatgtcactgcctccccaccatgccacattggaccctgtggggaacgctgcccggatgggggcagcttcctggtgatggtctgtgccaatgacaccatgtatgaggtcctggtgcccttctggccttggctagcaggccaatgcaggataagtcgtgggggcaatgacacttgcttcctagaagggctgctgggcccccttctgccctctctgccaccactgggaccatccccactctgtctgacccctggccccttcctccttggcatgctatcccagttgccacgctgtcagtcctctgtcccagctcttgctcaccccacacgcctacactatctcctccgcctgctgaccttcctcttgggtccaggggctgggggcgctgaggcccaggggatgctgggtcgggccctactgctctccagtctcccagacaactgctccttctgggatgcctttcgcccagagggccggcgcagtgtgctacggacgattggggaatacctggaacaagatgaggagcagccaaccccatcaggctttgaacccactgtcaaccccagctctggtataagcaagatggagctgctggcctgctttagtcctgtgctgtgggatctgctccagagggaaaagagtgtttgggccctgcagattctagtgcaggcgtacctgcatatgcccccagaaaacctccagcagctggtgctttcagcagagagggaggctgcacagggcttcctgacactcatgctgcaggggaagctgcaggggaagctgcaggtaccaccatccgaggagcaggccctgggtcgcctgacagccctgctgctccagcggtacccacgcctcacctcccagctcttcattgacctgtcaccactcatccctttcttggctgtctctgacctgatgcgcttcccaccatccctgttagccaacgacagtgtcctggctgccatccgggattacagcccaggaatgaggcctgaacagaaggaggctctggcaaagcgactgctggcccctgaactgtttggggaagtgcctgcctggccccaggagctgctgtgggcagtgctgcccctgctcccccacctccctctggagaactttttgcagctcagccctcaccagatccaggccctggaggatagctggccagcagcaggtctggggccagggcatgcccgccatgtgctgcgcagcctggtaaaccagagtgtccaggatggtgaggagcaggtacgcaggcttgggcccctcgcctgtttcctgagccctgaggagctgcagagcctagtgcccctgagtgatccaacggggccagtagaacgggggctgctggaatgtgcagccaatgggaccctcagcccagaaggacgggtggcatatgaacttctgggtgtgttgcgctcatctggaggagcggtgctgagcccccgggagctgcgggtctgggcccctctcttctctcagctgggcctccgcttccttcaggagctgtcagagccccagcttagagccatgcttcctgtcctgcagggaactagtgttacacctgctcaggctgtcctgctgcttggacggctccttcctaggcacgatctatccctggaggaactctgctccttgcaccttctgctaccaggcctcagcccccagacactccaggccatccctaggcgagtcctggtcggggcttgttcctgcctggcccctgaactgtcacgcctctcagcctgccagaccgcagcactgctgcagacctttcgggttaaagatggtgttaaaaatatgggtacaacaggtgctggtccagctgtgtgtatccctggtcagcctattcccaccacctggccagactgcctgcttcccctgctcccattaaagctgctacaactggattccttggctcttctggcaaatcgaagacgctactgggagctgccctggtctgagcagcaggcacagtttctctggaagaagatgcaagtacccaccaaccttaccctcaggaatctgcaggctctgggcaccctggcaggaggcatgtcctgtgagtttctgcagcagatcaactccatggtagacttccttgaagtggtgcacatgatctatcagctgcccactagagttcgagggagcctgagggcctgtatctgggcagagctacagcggaggatggcaatgccagaaccagaatggacaactgtagggccagaactgaacgggctggatagcaagctactcctggacttaccgatccagttgatggacagactatccaatgaatccattatgttggtggtggagctggtgcaaagagctccagagcagctgctggcactgacccccctccaccaggcagccctggcagagagggcactacaaaacctggctccaaaggagactccagtctcaggggaagtgctggagaccttaggccctttggttggattcctggggacagagagcacacgacagatccccctacagatcctgctgtcccatctcagtcagctgcaaggcttctgcctaggagagacatttgccacagagctgggatggctgctattgcaggagtctgttcttgggaaaccagagttgtggagccaggatgaagtagagcaagctggacgcctagtattcactctgtctactgaggcaatttccttgatccccagggaggccttgggtccagagaccctggagcggcttctagaaaagcagcagagctgggagcagagcagagttggacagctgtgtagggagccacagcttgctgccaagaaagcagccctggtagcaggggtggtgcgaccagctgctgaggatcttccagaacctgtgccaaattgtgcagatgtacgagggacattcccagcagcctggtctgcaacccagattgcagagatggagctctcagactttgaggactgcctgacattatttgcaggagacccaggacttgggcctgaggaactgcgggcagccatgggcaaagcaaaacagttgtggggtcccccccggggatttcgtcctgagcagatcctgcagcttggtaggctcttaataggtctaggagatcgggaactacaggagctgatcctagtggactggggagtgctgagcaccctggggcagatagatggctggagcaccactcagctccgcattgtggtctccagtttcctacggcagagtggtcggcatgtgagccacctggacttcgttcatctgacagcgctgggttatactctctgtggactgcggccagaggagctccagcacatcagcagttgggagttcagccaagcagctctcttcctcggcaccctgcatctccagtgctctgaggaacaactggaggttctggcccacctacttgtactgcctggtgggtttggcccaatcagtaactgggggcctgagatcttcactgaaattggcaccatagcagctgggatcccagacctggctctttcagcactgctgcggggacagatccagggcgttactcctcttgccatttctgtcatccctcctcctaaatttgctgtggtgtttagtcccatccaactatctagtctcaccagtgctcaggctgtggctgtcactcctgagcaaatggcctttctgagtcctgagcagcgacgagcagttgcatgggcccaacatgagggaaaggagagcccagaacagcaaggtcgaagtacagcctggggcctccaggactggtcacgaccttcctggtccctggtattgactatcagcttccttggccacctgctatgagcctgtctctacagtagaaggagattgtggggagagaaatcttaagtcataatgaataaagtgcaaacagaagtgcatcctgattattttcagaagctgatgaggaatatgggtaaaatgttaatgctttccacccacctgagaatcagtgttcctgggttgccatatctggagtctctttccatcataaataatcccactgcctcttttcatttcctgaaggctgctccctcctcaccccaccattagaagtaacacagacagctgcagcata

SEQ ID NO: 30120 - DNA, 1711 bp, Homo sapiens
agagactcactcttccgatattttgagttgctagaaaagcttcagtataacctagaggaacgtaagaagttacaagagtttgcagaaccccagattacacccctggtctccagttctccatctccatgtctgcctgttcctttctgcatcactggctcctaactcaagcaatctccttgggtttctctgaggggcccctgggatcccctatcattagtccctctcacagaagcatacccttctccagagctaaaggatcagatattcagcggctcaggtgagaataaccagaactcacctccggtaccagtgttcacttggaaacatggctctcagcctctggcccctgctgctgctgctgctgctgctgctgctgctgtcctttgcagtgactctggcccctactgggcctcattccctggaccctggtctctccttcctgaagtcattgctctccactctggaccaggctccccagggctccctgagccgctcacggttctttacattcctggccaacatttcttcttcctttgagcctgggagaatgggggaaggaccagtaggagagcccccacctctccagccgcctgctctgcggctccatgattttctagtgacactgagaggtagccccgactgggagccaatgctagggctgctaggggatatgctggcactgctgggacaggagcagactccccgagatttcctggtgcaccaggcaggggtgctgggtggacttgtggaggtgctgctgggagccttagttcctgggggcccccctaccccaactcggcccccatgcacccgtgatgggccgtctgactgtgtcctggctgctgactggttgccttctctgctgctgttgttagagggcacacgctggcaagctctggtgcaggtgcagcccagtgtggaccccaccaatgccacaggcctcgatgggagggaggcagctcctcactttttgcagggtctgttgggtttgcttaccccaacaggggagctaggctccaaggaggctctttggggcggtctgctacgcacagtgggggcccccctctatgctgcctttcaggaggggctgctccgtgtcactcactccctgcaggatgaggtcttctccattttggggcagccagagcctgataccaatgggcagtgccagggaggtaaccttcaacagctgctcttatggggcgtccggcacaacctttcctgggatgtccaggcgctgggctttctgtctggatcaccacccccaccccctgccctccttcactgcctgagcacgggcgtgcctctgcccagagcttctcagccgtcagcccacatcagcccacgccaacggcgagccatcactgtggaggccctctagggccggcgcagtgtgctacggacgattggggaatacctggaacaagatgaggagcagccaaccccatcaggctttgaacccactgtcaaccccagctctggtataagcaagatggagctgctggcctgctttagtcctgtgctgtgggatctgctccagagggaaaagagtgtttgggccctgcagattctagtgcaggcgtacctgcatatgcccccagaaaacctccagcagctggtgctttcagcagagagggaggctgcacagggcttcctgacactcatgctgcaggggaagctgcaggtaccaccatccgaggagcaggccctg

SEQ ID NO: 30121 - DNA, 2178 bp, Homo sapiens
gccctgccctcacctggctatcccacacaggtgagaataaccagaactcacctccggtaccagtgttcacttggaaacatggctctcagcctctggcccctgctgctgctgctgctgctgctgctgctgctgtcctttgcagtgactctggcccctactgggcctcattccctggaccctggtctctccttcctgaagtcattgctctccactctggaccaggctccccagggctccctgagccgctcacggttctttacattcctggccaacatttcttcttcctttgagcctgggagaatgggggaaggaccagtaggagagcccccacctctccagccgcctgctctgcggctccatgattttctagtgacactgagaggtagccccgactgggagccaatgctagggctgctaggggatatgctggcactgctgggacaggagcagactccccgagatttcctggtgcaccaggcaggggtgctgggtggacttgtggaggtgctgctgggagccttagttcctgggggcccccctaccccaactcagcccccatgcacccgtgatgggccgtctgactgtgtcctggctgctgactggttgccttctctgctgctgttgttagagggcacacgctggcaagctctggtgcaggtgcagcccagtgtggaccccaccaatgccacaggcctcgatgggagggaggcagctcctcactttttgcagggtctgttgggtttgcttaccccaacaggggagctaggctccaaggaggctctttggggcggtctgctacgcacagtgggggcccccctctatgctgcctttcaggaggggctgctccgtgtcactcactccctgcaggatgaggtcttctccattttggggcagccagagcctgataccaatgggcagtgccagggaggtaaccttcaacagctgctcttatggggcgtccggcacaacctttcctgggatgtccaggcgctgggctttctgtctggatcaccacccccaccccctgccctccttcactgcctgagcacgggcgtgcctctgcccagagcttctcagccgtcagcccacatcagcccacgccaacggcgagccatcactgtggaggccctctgtgagaaccacttaggcccagcaccaccctacagcatttccaacttctccatccacttgctctgccagcacaccaagcctgccactccacagccccatcccagcaccactgccatctgccagacagctgtgtggtatgcagtgtcctgggcaccaggtgcccaaggctggctacaggcctgccacgaccagtttcctgatgagtttttggatgcgatctgcagtaacctctccttttcagccctgtctggctccaaccgccgcctggtgaagcggctctgtgctggcctgctcccaccccctaccagctgccctgaaggcctgccccctgttcccctcaccccagacatcttttggggctgcttcttggagaatgagactctgtgggctgagcgactgtgtggggaggcaagtctacaggctgtgccccccagcaaccaggcttgggtccagcatgtgtgccagggccccaccccagatgtcactgcctccccaccatgccacattggaccctgtggggaacgctgcccggatgggggcagcttcctggtgatggtctgtgccaatgacaccatgtatgaggtcctggtgcccttctggccttggctagcaggccaatgcaggataagtcgtgggggcaatgacacttgcttcctagaagggctgctgggcccccttctgccctctctgccaccactgggaccatccccactctgtctgacccctggccccttcctccttggcatgctatcccagttgccacgctgtcagtcctctgtcccagctcttgctcaccccacacgcctacactatctcctccgcctgctgaccttcctcttgggtccaggggctgggggcgctgaggcccaggggatgctgggtcgggccctactgctctccagtctcccagacaactgctccttctgggatgcctttcgcccagagggccggcgcagtgtgctacggacgattggggaatacaacaagatgaggagcagccaaccccatcaggctttgaacccactgtcaaccccagctctggtataa

SEQ ID NO: 30122 - DNA, 4291 bp, Homo sapiens
cctgccctcacctggctatcccacacaggtgagaataaccagaactcacctccggtaccagtgttcacttggaaacatggctctcagcctctggcccctgctgctgctgctgctgctgctgctgctgctgtcctttgcagtgactctggcccctactgggcctcattccctggaccctggtctctccttcctgaagtcattgctctccactctggaccaggctccccagggctccctgagccgctcacggttctttacattcctggccaacatttcttcttcctttgagcctgggagaatgggggaaggaccagtaggagagcccccacctctccagccgcctgctctgcggctccatgattttctagtgacactgagaggtagccccgactgggagccaatgctagggctgctaggggatatgctggcactgctgggacaggagcagactccccgagatttcctggtgcaccaggcaggggtgctgggtggacttgtggaggtgctgctgggagccttagttcctgggggcccccctaccccaactcggcccccatgcacccgtgatgggccgtctgactgtgtcctggctgctgactggttgccttctctgctgctgttgttagagggcacacgctggcaagctctggtgcaggtgcagcccagtgtggaccccaccaatgccacaggcctcgatgggagggaggcagctcctcactttttgcagggtctgttgggtttgcttaccccaacaggggagctaggctccaaggaggctctttggggcggtctgctacgcacagtgggggcccccctctatgctgcctttcaggaggggctgctccgtgtcactcactccctgcaggatgaggtcttctccattttggggcagccagagcctgataccaatgggcagtgccagggaggtaaccttcaacagctgctcttatggggcgtccggcacaacctttcctgggatgtccaggcgctgggctttctgtctggatcaccacccccaccccctgccctccttcactgcctgagcacgggcgtgcctctgcccagagcttctcagccgtcagcccacatcagcccacgccaacggcgagccatcactgtggaggccctctagggccggcgcagtgtgctacggacgattggggaatacctggaacaagatgaggagcagccaaccccatcaggctttgaacccactgtcaaccccagctctggtataagcaagatggagctgctggcctgctttagtcctgtgctgtgggatctgctccagagggaaaagagtgtttgggccctgcagattctagtgcaggcgtacctgcatatgcccccagaaaacctccagcagctggtgctttcagcagagagggaggctgcacagggcttcctgacactcatgctgcaggggaagctgcaggggaagctgcaggtaccaccatccgaggagcaggccctgggtcgcctgacagccctgctgctccagcggtacccacgcctcacctcccagctcttcattgacctgtcaccactcatccctttcttggctgtctctgacctgatgcgcttcccaccatccctgttagccaacgacagtgtacagcagggctacagagggtcagaggaaaacagtttggaggaagacaaagggttaagacccatgactcctcgcagcctggctgccatccgggattacagcccaggaatgaggcctgaacagaaggaggctctggcaaagcgactgctggcccctgaactgtttggggaagtgcctgcctggccccaggagctgctgtgggcagtgctgcccctgctcccccacctccctctggagaactttttgcagctcagccctcaccagatccaggccctggaggatagctggccagcagcaggtctggggccagggcatgcccgccatgtgctgcgcagcctggtaaaccagagtgtccaggatggtgaggagcaggtacgcaggcttgggcccctcgcctgtttcctgagccctgaggagctgcagagcctagtgcccctgagtgatccaacggggccagtagaacgggggctgctggaatgtgcagccaatgggaccctcagcccagaaggacgggtggcatatgaacttctgggtgtgttgcgctcatctggaggagcggtgctgagcccccgggagctgcgggtctgggcccctctcttctctcagctgggcctccgcttccttcaggagctgtcagagccccagcttagagccatgcttcctgtcctgcagggaactagtgttacacctgctcaggctgtcctgctgcttggacggctccttcctaggcacgatctgctacaactggattccttggctcttctggcaaatcgaagacgctactgggagctgccctggtctgagcagcaggcacagtttctctggaagaagatgcaagtacccaccaaccttaccctcaggaatctgcaggctctgggcaccctggcaggaggcatgtcctgtgagtttctgcagcagatcaactccatggtagacttccttgaagtggtgcacatgatctatcagctgcccactagagttcgagggagcctgagggcctgtatctgggcagagctacagcggaggatggcaatgccagaaccagaatggacaactgtagggccagaactgaacgggctggatagcaagctactcctggacttaccgatccagttgatggacagactatccaatgaatccattatgttggtggtggagctggtgcaaagagctccagagcagctgctggcactgacccccctccaccaggcagccctggcagagagggcactacaaaacctggctccaaaggagactccagtctcaggggaagtgctggagaccttaggccctttggttggattcctggggacagagagcacacgacagatccccctacagatcctgctgtcccatctcagtcagctgcaaggcttctgcctaggagagacatttgccacagagctgggatggctgctattgcaggagtctgttcttgggaaaccagagttgtggagccaggatgaagtagagcaagctggacgcctagtattcactctgtctactgaggcaatttccttgatccccagggaggccttgggtccagagaccctggagcggcttctagaaaagcagcagagctgggagcagagcagagttggacagctgtgtagggagccacagcttgctgccaagaaagcagccctggtagcaggggtggtgcgaccagctgctgaggatcttccagaacctgtgccaaattgtgcagatgtacgagggacattcccagcagcctggtctgcaacccagattgcagagatggagctctcagactttgaggactgcctgacattatttgcaggagacccaggacttgggcctgaggaactgcgggcagccatgggcaaagcaaaacagttgtggggtcccccccggggatttcgtcctgagcagatcctgcagcttggtaggctcttaataggtctaggagatcgggaactacaggagctgatcctagtggactggggagtgctgagcaccctggggcagatagatggctggagcaccactcagctccgcattgtggtctccagtttcctacggcagagtggtcggcatgtgagccacctggacttcgttcatctgacagcgctgggttatactctctgtggactgcggccagaggagctccagcacatcagcagttgggagttcagccaagcagctctcttcctcggcaccctgcatctccagtgctctgaggaacaactggaggttctggcccacctacttgtactgcctggtgggtttggcccaatcagtaactgggggcctgagatcttcactgaaattggcaccatagcagctgggatcccagacctggctctttcagcactgctgcggggacagatccagggcgttactcctcttgccatttctgtcatccctcctcctaaatttgctgtggtgtttagtcccatccaactatctagtctcaccagtgctcaggctgtggctgtcactcctgagcaaatggcctttctgagtcctgagcagcgacgagcagttgcatgggcccaacatgagggaaaggagagcccagaacagcaaggtcgaagtacagcctggggcctccaggactggtcacgaccttcctggtccctggtattgactatcagcttccttggccacctgctatgagcctgtctctacagtagaaggagattgtggggagagaaa
